United States Patent 10,724,096 (METHODS AND COMPOSITIONS FOR INHIBITING AND TREATING NEUROLOGICAL CONDITIONS) - sequence listing, part 114

SEQ ID NO: 2047 - DNA, 1694210 bp, Homo sapiens
ctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggtaagtccaggcggagtcattgcctctgcacccaccctgacctggtgggtcaggtccagaaggtctcatggagggaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggctacctcgtccgtcctcctgggagcgagtcctaggtgccaggagcagcgggagcctgcctgcgcactttgattagtctccctggccggctgcaagcgtgcactcagcgcgcccccggaccgctgcctccgcccgcagggtgtgcaggaggaggcatcttagtgacccgggagggtgtttaggtgccccgaaccccttgtgggaggaggggaagagaaggctcacttatgtggagaaagcgccgctgtgtttactggcactggaatcgatgccccgcggtgccacctcgaccccaggggagggggccagccgggaaacctgcgaatgggaaactcctactgtgcccctggttcctgggagccttagagaaccttcaccccagagaaggaaacacaggggtagcagatcttagccctgtgttgttgtgcaggccaggggggggcttgtcagctccaatcaaccaattgtccagctatggaagcgagggcggggctagtggggcgccgctcccatctccccaccgcccaggaggccacttggctgtgagctcctggagcctccctggcgccagctgcggggaccaggtgtcacgcggagcccggaagctgtccactcagcaagggaggggaagaccccgatctaaccttgtcctggagcccccagctccattccttgctgccagggaatggtcagggggctgggagagctcatcgctcctgtgtgggccagagctggggtgcacctgctggcactggaacatctggggtgcggctactgaagagcttggaaatcctggtcaggcagtccgggcaattggcaccccaaaggcggatcttttcagttgaacttgaaaagaagtgggggagtgtggtgaaatagctttgttgagttgaaacatcatgtctcctaacttgggttttcctttattagaataatgattgtttatttttatttttaaactccgttgtgcagagaggcctggccttgacagcccaagtttaggacatgccccagcctgccatcccttccctgccccctgtcctagttcatctcccctccatttatcattttatctttgttacaaaagagagaaaaaaaagatgagagggcctggattctttcaatttttaagtgaccacagaggccccggctggagctactggcagatttatttttagctaagatcttttatgttcagaagcaaaggacctggggcctgtgaagggtaaaggtggtgctggcagtggctgtgctggtaaaaagtggggctgactcaaaacctgtgtcctctttgagctcgtcagggaggccctccgtttggaagaatcccctgggctttccttaagttagcttatggttgcctcgggttaggaagaaaagtcatcattcctcgcggtagtggaagtgacaccttaggggtccagagagtggagctttatggctcagaagagcacagggcttctggatccgttatctgccagctgtgtgaccttgggcaagttgctttacctctctgagcttcgggttgtcacctgtaaaatcagagtttcagtcgtagttctgtcctcagagggtttgggggtaaattacttaaagcactaaacatttagaacagtttggcacatggtaagtgcctgaattctatgagttttgtttctttattctttcaagtagattcctctaatttttgagccttgtagcaccgagtggtacaggaaaggcaggtggcttgccttatacacacacgttttcttttaagtaaggaacagaagcctcaagctctcccattctgctctctgcatgttccaaggaggatcacggacaagctgcccacccactggccaagatataggttggtggcatttgacttgctgtcttgacaagcacctgaaattaagtttttgcagcagttgtacatttcttctgacccactgaaaggacttgatctccttggccccctgggatgaaagtattaccttagcaaatctgtttttttttttttaattagaacatcatttatttaatacatagaatattttgaaaacacaagaatcgaagaatattagaagtggctttatcattcctcctgggattcacacattgcaattagtatgtttagatataaaattttgtggccaggtgcagtggctcatgcctgtaatcccatcactctgggaggctgaggtgggcgtattgcttgagtccaggagttcaagaccagcctggacaacttagcaaaaccctgtctgtactaaaaatacaaacaattagatgggtgtggtggtgcacacatgtaatcccagctaccctggaggctgaagtgggagaatcacctgagcctgagaaggttgaggctgcagtgagccgatatcacgccactgcactccagcctgggtgaccagaatgagaccctgcctcaaaaacaaaacaaaacaaacaaacaaacaaaaaacaatttgtgatagtatctaaacaatttgtgatagtatttaattgtataaacatataaacatctgtggcacacatttgcccataaatgaactgaatgcacaaataccttgatccagtttttagaaagaattttagttttgttgtggcaagaacacaacatgggctgtaccctgtgaaaagatttctaagtatatcatacatgactgttttaaggatagtattgtataggagatgtcaaggagttatttacctttactgcatgagggattcggggatctaaaatcgtcaaactcatagaagcagagagtagaaggttgtggccagggtctcaggggccagggaaatgaggatttgctgatctaatcaacaggtataaagtttcagtaatgttgtaataaatcttgctgtccgtagaacgtacagttttttacatcaccctgaagctacagagttttccactcagaaatgaagctgaaacatgggtctgagcgggtttctcctcctggaattgacccactctgccctatttttcttctcattataattgaagctatatatatatatatatatagaacctgctcctgtaaggtttgagcacaggtcttctagacatcctcatgtctctgatgattttagaaaaaaattaagcttagtccttttagctcgaaccatcccaagctattatattttatcaaagtcctttctgatagtacatattttttgtatccagaaaattgggtctgccctgtataggaatctgacatttcacctttccaaaaattagaccatttcgtttgcatcctttaagctgatgtgtggagtaatgaacacattccaagagggaaatcgtatttgacacagaaaatactttggagacgcagcgatttcccagtggcgtgtaaggagactattgaaatcctagcacgtttgctctgaaggacagagggcagctcgtcctgcctttgccacccagcatgggagttacacagtaagcatcatccacaaattaatactggctgactttcctaaaatcatcctttaatctgtcgctttcacatttacccacagtgtcgtgccggagacctcaaacaccgaggcgacgtttttaaagaagccacgaggctcttcccaatgtctacctccattatttaaaatactgcctcgaggcacaggtataaatattaaaactttaattaaagaatcaatcagtgatggagcttcaaaacaaggggatctagcactttcagatgatgtcaactgtgaacacagttagactcggtcgtagggctaggagtttttatgaaaaatgacgcgtggagttatatacacaggcaactgtcctcattttttgaatctgtagtcattgtgagcactgtcactcattaccactggtttgtcattgttcgctagtcaaagagacatgggtgactgtggcctgctgctacagaagagtgtgttgtcttaggggaaggagtggctaatgcaagaaatatttatttggaatgtaccacatgttagaccctgtgcttggtgaataaggcagacgagaactttcctttcttgtagcttatattgtcgtgggggaagccgcgtcataagcaagacgttgaaatatattttcataaggataatgaaaagggttccaaaaattatagtgtgatagtgacttggggggacattccagagaggagagatttgacctgagaagtacatgaaaagaagtagctgatctgtatggatccatacatttatccaatgagtattctactcatctccgctttcttttttttgaaacagagcctcacgttgtatcccaggctgtagtacagtggtgtgatctcatctcactgccacctccacctcctgggtacaagtgattattatgcttcagcctcctgagtagctgggattacaggtgtgctctgccacgcctggctagtgtttgtatttttagtagggatggagtttccccatgactggtcttaaacgcctgacctcaagtgatccacccgcctcctcggcctctcaaagtgctaggattacaggcgtgagccaccacgcccagcctcattcacccctactttctatgaattcctgagtgttcatcaggcacccactgtgtgccaagcactattgaaagcacttcaagtgcagagtgatcaatacatgcagataccttgtcctaaaagacttccgttctaggatagttgtctgcatggagggcgtttcagagaaggggaccaacaagcacaacgatccagaggctggaatagtgacaaaatcatacagttgaaggttggtcctataggcccttgtggcctgggaagggaccctggctgttattctaatgggaaaccattgggggattttatgcagagagataccaggatatatttatgtcttaaacattatgggaaaattgttaggtgtttttgagatgagtgaataaacaagcatgccttcctggccggccggctctattttttcaaagtttcaattcatttctatgaccagatttggtctgtggacgtagtgacatctgaaaaggtaagccttgcaacgtctgagaaattaaactcgattccccaccaccacctacttcgtagggcttacactaaaatctttcattcaagaagagggattactttatagggaaaaagaacctcattttccagtaatgttctttgtgtgagggtggaagaccctgggaggatacatctgtatacattagcctacttagattttctttctctggggcctcccttcaaagaggcaacatcatgtgttcttgtgtgcctgcatgagcagccgcaccctcccaccaccacatccttttgatggcttgactgacaagtctcctgggagtaccctgagaacagttgcactcagatgccctttattgatcgtctgtccgggtaggttccctttcagagtatggccacagattctcccattggtaggtgtgggccagggtaataacagatattgacagtgcaaagtgggttgcttatggagagctctgagtgcagccgacgttgtccatcttcagaggctaccctgcccttagaaggttgaggtgcaatttgttggagggtttggacacctggacaattcagttttcctcccacattgactgtctctttatccacaatactggaactgcattattgcctattatatgtgacatgaacatcagaataagtgtacatggattgaactcttcctatgtagcacaagctgagccaagcactgtaccttcatggctgtgtgttgtgctatgtgtttcaggcatgtgatcgcctcccccacccacccagcagttcaccttattcgattcctgctcatccttcaggttacaactcaaaagccccaggcttagagaaactgtccctgtttgcctgtgtcgattctcgttttttacagccatcccaggggcatcttatattttattgagtgactctgttttatcctttttctcttactccactccatggtcaactgcaggtggaccatgcatacacctgtttggacatcactgtctccttagcatctagcgtggtgcaaggcacacagcagaagccccatatggaaataatgaattattccatttgatgcttctcacacactttgaggttagtgcttttcagatccccattttgcagatagagagtggggtgtaggcaggcgttaagcaatttgtccaaggacacaacagcaggtaagaggcacttccaagattttgaacctgacagtctgagtccacagcccctgatgctcatcactgtgcacatggcctcttttgctgcctttgcaagatacaagggagggtgggaggcaatgtgtgcagtggttagggagctcttgctgcatagcttgagttgctctgagaagtgatgctgagcccattagagccacaaaaggaaaacaaggcacttgtttctatttattgcagtattactttatcgttgtgtaagagcctcgctagatttctgcactggtgcaatctggctcttgttttgttgtttgtctccttggagtctcaaggccctgggttgcccagggcatctctggcctctttatctaggctcacgctctgagtatgattttgagggagcggttggaccacctgcctggttacaggcagtccttgggcatcatgcagtcacagctggagctgctctgatagccactcaaaatgtggtgtgcaaaccactgctcactccatctaatcaccgtcatctgaatcagcttccctcttcatttcttctgagaacaaaattagatctttgccagcataatggatgaacttgtgcaatcaccttgttcattgctagttctgcatttccccaagatgttgatgtctcttttctgtgaattttagaatatagagtgtcagagatgagggtgaggacttgaggttttcaaaattgtcttctttgtaccatggttgggaccctaatagctatgacactcactggaagctccttctgtgctagggcttcctgtgtgtcatttcattaactcttcatggcaaaccctttattataccacttgacagatgaaggaactgaggcccagtgactaaatggcaaaccgagattgcagactcaagcagttctcttcccctgctgtgtgtggagagggcatgcttgggatgcagggaatagcagaggcaccatgataaggtactaggaaggaggcagtgcaggtatttcactgagattccagaatcagtgtgtctggcttgagatcccagctccatcactttctaagtccataacctttcactttcttcaatttctctgaacctcagtccatccctacaaatggagattatcactacattgtacagtccgtctgaggattaatcagcctggtaaattattttagcaaagtgcctggcacctagtgtgtgtttagtgcaagtaggagtcatagggctgactatgataatcatgacgattactattatccattgataataatgatatcattattaaccttgtttttgttgctagaatttcacaatccctttgggcagcaaattggtcccagaatgtgcttcgtatattttcctcttgactgtaactgaggtgacaaattgagagtgaagggggaagaacccagcgtagctgcaaatgtacggttgagatcgttgacagacttgaggccctgtgtggagttccgcctgcagaggatgctgacagcagccatatgcatgggctctgattgattggcagagagaaacactaatttattagactcgttatgaaaagtgacggagcaggggattgagagggctgattcagcaacagtagccctggctagatcccaggggtattggcttggtgtctgtttcccttgggaccagccccctgtcttgattctgggtcactgcctgtgttctcaagtgagtctcctgaagatgtccatggcatggctcacttttaccacgttgtaaatgtcatacctatttcttcagtatccttagaaagctgagtccagttcaggttgctgttgattgcaaaggctgataagaggagggagggagtgtgtgcatgcagaaattccccagtggagggaaaatagtccttttcacaggttagagaaagtgcagtagtttccttgagggagaataaagggcatggttgatacctctctttaagaacatgatgaccgggcatggtggctcctgcctgcaatcccaacactttgggaggctgaggcaggaagattgcttgagccaggagttggagaccagcctaggcaacataatgagaccctgtctctgttaaaaaaaaaaaaaaaaaaaaaaaaattagctgggtgtggtagctcatgcctgtagtcctagctactcaggaggctgggacaggattgcttggctctgggagtttaaggctgctatgagctgtaattgtgccactgcactccatccttggcaacagagcaagaccctatctgtaaaaaaaaagaacatgaagctctttgtagaaagatttctcatttctgatttggagagattgttcagtctgaattacagcaggtaggatgctggttaaagaagtgtcttgccttcaaggtgataaggcactgaatggggctatgttggagtcagaaaagctttgagaagactgaattccctgagcgccaaggtgcgaaaggacaaagtcatggcagccaggtacacttaacttgtggatccagattctgccacttcctggctgtgtgagcttgggccagttactgcacctctctgagcctccatttacttgtctattaaaaggcaaatgattctgtctccaaggatggctacctgggagtgagttaagtcaagcagcaatcacacagacttccgagctagtcacttcttatttttttttaccttgtggtattcagacaatagcctctcaccccatgactctttgatacaaaaggttccctagttagtgtgctgtgatttgtggaaagatattttgtttcctagtgaatttcattcattttgctcaggaaactttattggttttgtctgtgtaaacctaaaataatcttcaaaagttcataacaagaacaaggaaccatccaccccattctataaacttatttctactgaattgtgcttcgctggtgtcagtttataatgagaaatagtataagaaagccgattagccacaaattttaaaaacttgacattatatatgcacactgaaagaggatagactatttaaagtttgagaatttttacagttgaatctagcatttgaaagaaaaacatggccgggcgtggtggctcacgcctgtaatcccagcactttgggaggctgaggcgggtggatcacgaggtcaggagatcgagaccatcctggctaacatggtgaaaccccgtctctactaaaaatacaaaaaattagccgggcgtggtggcgggtgcctgtagtcccagctactcggaaggctgaggcaggagaacggcgtgaacatggggagcggagtttgcagtgagccgagatcgcgccactgtactccagcctgggcgacagatcgagactccgtctcaaaaaaaaaaaaaaaaaaaggggaaagaaaaacatgttattgaatgtaggtgagggataagaaccaagaacttctggtaagaacccagcaggacaagcgagctatgaagaattcaactctctaatgttatttgctatgattattattgttatttttttgagacagagagtctcatttgttgcccaggctggagtgcagtgatgcaatcatgtctcacttcaacctctgcctcctggactcaagtgatcccacctcagcctcttgagtagccaggaccacaggcatgtgccaccaagcctggctaattttcgtgtttttaaatttttgtatttttttgtagagttgtgatttcaccatgttgcccaggctggtcttgaactcctggggtcaagcaatcttcccttacaaagtgctgggattacaggcatgagccactatgcccagccctatgatgatatttttgaggactctgttggctattactgtgttagctttggtttcaggatcagaaagagtttgtcctttcttcaggttctgattggtatttatgtaccagacacttctaagtggaatacctgtccatgttcccttttcacaaagcctgccaggaatctcagagctgattttatagttcagtcacagtagtaaatagaatttgatagcatggattttgcgtattaacctcacttttgactcagttttatttctctacccttccattttaattttctctttttattgtgatgtatgttactgtatcaaaagaatacctttgcaaggtacctaatgtgaacatattcaaatattgaataagaaagcaatataaaggtatataaggtaggtgaacattgaaaggtatacataaattacagccctttaaaacaccaggaaccctggaaaataggaccatatagtgcagtgcttggtatcttgagctagacctgaagttagagaaatgcaattttgagtcccaacagtgcaaatggttactctttcttattttctccttttaaaaaacattttcctggagcactatttatgctatataaattcacttttattgggccatttattgcctttttcatgcattcagcaaacatttttgagcccatgctctgggccaggcactgttaggcactggggatactgtatggggtgggtatattgaccaatattgacatcatctctgcctagtgaaacttatgctgtagtgagagagactgacacgaaacatgaatgcaggtaaaaagacaatagaattacccgttatcataagtattaaaacggcaacagaatggagcattcatgtaataaaagagtgagtgaccctgttcggtaggaacatcagggaaatgtctccaaggagaggtattgggccacatttaagctacggcctgaagactgagaagggccaagctgtgaccagtggggagaagagaagagaggagaccatggtgagcagaggtggcagtgtgttcagaagcccgggggaggaaggagagggctctgcacatcctgagaacagcaaggtggccagcgtgcctggggtggtgagagcaagggaagggatgtggctggcaaagcctgcagaggccagaacaggcagccttgctctcaggagcctgtgccctgtgttatttttgagatggggaagatcttaactagtaccatcctttataagcatattcaagataggtgcgagaataaggtacaaggagcaccatgccagaaaagcaatgtgtgtgcctctgtgtgtgcatgtgtagatgtgtacacttgtatgtgcacatgagtggatgtgcacacacatctctgtatgtgtgcaaacgtgcatttttgtgtacatttctgcacgtgtgtgtatgtatgtacatgcatgtatgtggcatgcgcatacgtgcatgtattgcagcaggaagagaaggagccacgaacagtatgacagtggggagattgctgacttcagagcccagcagaatgagggtcagtgttgctgggcacgctgcttacagcatgtgcagagcatagctctgttttgcctcacatccctcctggactgatccctttctgtttgtatggtacattcagtgagtgacagcatcacaggaggcagaccccagccttatgaacatatcttcataacaccatacagtctcacgagaaaggggaggtcatttgttcactgtagtccacccctgaattgttccctcactggctctgtgtcactttcagagatttttttaaattctgggaaatgctttggggacttcggcattttggagtgtgttttcaaggattgtattagcaccacagagacccttagcctctttcttaaaggttctgtttttagacatcctcctcttttatccgtgctttcaattctgctgcttccttccttctgagattccttcttccttgctggtcttggaacaagaaacatttagctgtattttcctcgttctcgcctaggtagggtgtggtccccctgtgtcctcatttgttcaacattttgagacaaagattggtggaattgccacttaaaaaaataaaaccagggaaagcagctcagagaatttaatttgcctctaacccaactcttctacttattaaaaaaatatacaattattcattccgtagcactccagattgcttcactgaaagaaagaaagaaagggatccactccagggagaaagaggctcttgagctttttgttccttgatgatcctgtctttacgtaatttggtggagcctactggggaatcatcattttgggagactatggatgtgcctcattgcagaagaataagtagagagcagtgtctggaacaaatgcttgtcttaaaaaaagtttatgaaatgccagcagatgtcagtgtgcccttgccatttgattttttttttaaagcaacattaattattttcggtagtaaaaacaacacaagtatattctgctacagttataaatgaaaagatcatgaggcaacgttttttaggtttggagaaggaccagcagaatttatgtcataaggtaaaatcctctaaattatctgtgtaatataatttgtcttttcccagaaaagtggtttcaaaatgcaaaacctagtgtaagttttttttttttttttccctctctcccagccattgttcaggtgccaataatagcttaggatccagcttagcttctgagaagctactggctctgctaattgataacagctccttatttcaaagctggagtttgcaaaggaaggtagtgtagggttgggtatggccttgtcgtttgtcatctgagttgtgatgagaaactcttgcagtttacgttgttaccgtgagcacagcaaattgcgtgctaatagttagttcctccgcagacattgtttggatcaaaaatgagggcctctatacaggaaaaagattcactcaaataattaaaaactattcattttaagcaagggataatttgccagcatgtagtgcaagagaggtagggtcgtttctaggcagggaatgatgtatgttacagggcatatttgatgctttgctttatttatttaatagttttgattaaatggtacaatattcaaaaatgcaggagtatgcagagaaaaataaatctctcttgcacttgccttgcagtttattagagacaactatttttatagtttctcatgcaccctttcatatatattttatgcgaatacaaacatttacacagatatttataccaacaaaagatagcatatgaaatgcatagttccactgtttgctctttttaaaaaaattaagaataccttttaaggattattccctctcattgtgtgtgtgtgtgtgcacacgcacgtgtattttttctgctccacctttgttaatggatatatagtattccattgcacatgcttacattatttaattggcctccttttgatggatatttatgttgtttccatttttgaagcgctacatggaatatcttcaaccgccaccacttcccacacatgtctgtaggatacattcttagaggtgaaattgttaggtcaaaggaaacatgcctttcattttgacagacactgccaaacctgatgctctggctgagctgcacccttacatgttggtggatgaatggggtttagaaccaaatgaagccatgtggtgattctggtctgacttggctaccgtgatgactgtcatgaattatgtccctattggaagtgtcttagtctagttctgctgctataacaaaatgcttatccagggtgatttagaaagaataggaatcgttggccaggcgcggtggctcatgcccgtaatcccagccctttgggaggccgaggtgggcggatcacctgaggtcgggagttcaagacctgcctggccaacttagtgaaaccatgtctctactaaaaatacaaaaattagctgggggtggtggtgggtgcctgtaatcccagctacttgggaggctgaggcagaagaattgcttgaatggagtcggaggttgcagtgagctgagattgcgccactgcactccagcctgggtgacagagcgagactgttgcgcaaaaaaaaaaaaaaaaaaaaaaaaaagaaaagaaaagaaaagaaaggaatagaagagaagttgttttctcatagttttggaggctgggaagtccatgatcaaggtgtggcaagttcaatgtctagtgagggatgcccgctctgcatccaagatggtgcttcctggctgcatcttcatatggtggaaggtagaagtgctgaagagtctgactagttctctccaacctttgggtaaggttcccatctaagcatgaaggcagagtcttcatggtctaaacagtccttaatagtgttgcattggagaataagtttgaacgtgaattttggcggggacacaaaccttcataccgtaacagaatgttttgcagttcttgtcattgctgtttttttgctaacactttccatctgccaagtagtttgttaagatctttaattccacgttcacatctttgtcctcataacaaccctgtggagtagaccctgctctcatcctgtttcaggatggggatgtgggggctgagagacctcaggtgctttgcttagggttacagggtggatggtcagctcaggagtcacactcagggcctctaggcttaaccattgagctgggaagctgtggtgggttttaagcagcagagagcatactattgagttacaatgagtttaatgtcaacccgattgtgctgttgaccttttggattgcataattatctgttgtgcaggctgtcctgtacactgtaggatgtttaatagcatccctggcctctacctgctagatgttagtagcacccccttcacccatccatgacaaccaaagacgtctccagattttgccaaacgtccctggggtagaaccttgccccactaactcagacaaagagcaaaatatgccgtgggcatctgtagcataacaccagagacatgtatttgaggacacacatggtggctgatgtcagggcatcttccattcagccgtctcagccaagggacactcatttagttcttccccaaggatggagcagatgggctgccccttgtggcagatgccagtctaggaagaaacaagacggtattactcaaaccatttcatcctccattcgatcacagtagcactgcccaacaagactttgtcttttaaaatgtagtttagaaacgtccttgaaaaattgcctggtaaagtagacttataaaaaattatgttcccaactatagtccagcttatatattatacagcttttctattcctgcattttcctttggtgttcagtaatgctctacatcaaaatggcaagcgggaggcatcagccctcccagctccctgcacgtggcagacattgataatcaattcttttcccccctcatcagcgtcaccttcttagaatcctcagtgcatctctctaggcatagactgtcaaccaattggaattactatgtgaaatgaaatgtatttgccacccctgttacatggtgcctttttggctgagaagaaggattacgctttccaaagaggcaagcttatcatgaggtattagcttatttttcagttactctgagaaaagtgcttgatagatgggaagaaatgtctattcttaaagcatttggaattacgatcttattttgtaacagtaattgggtgcctgaagaatactcctctttcctgaggtgctttacatatactatcatcctatgtattattgtttttctgtagtaacatctctctcccctccaccaccaaaaatcagtcccctcccttcaaagcctggtggaggcagccacctgagggtgacacaaaacgctttgtgtacaatgggaactgagacaattccctcagcaaagaacattgagaagctgcaggacgttactggaactgtgtcacttctcagcacagggcatgtgagggagctttaaagagatggggaactgaaccatccaagatttccagaagtaacttctgatgtataaaggcatggaggccaggctgctctgggaaggcaacacaggtttcagagttgaaaatgcttttaggtggcatcatagaaccatccattctagcataatgttttgtgttttttttttgccattgcttttttggggaggggtggaaaaactcccatggaattgtgtggtaacttggtaatttggtttagtaacttgatgaacctatatgcaaatacctatcacttagatagtttttaagtcatctcctgtttctgattctaagaaaatagagaaaaataatcttggaaagaaaaggccctgggtcagacagtgtctgtctctttttatttttcagactggtgggaatgttttcctttctccacttttagatgttttagtctgtgagagatagggacaaatacaacacgtctcctatttcctcttctgagaaaggaatttttaacttagatgggaggcaccagtgaacttcaagggcttgaaattgcatttaaaatttaaagaataaacatttttatctgggcagaaggctcatagctttttaaaaatcacattctcaaagtgctatatgggacacacaaaaaagtaagagcccatctttttcagaacaataactttcagactcttttaccatgaccctagtaggcaaggaaaaaggatactacagcccaaccacttcacctgttttaaccttctggtgggactgtgtgtgttggaggtggggggagacagggaggtcacagaaagctcagtagtgatgaaggattggggtgcaactgtatttggtgggagagatacttacctcttacttagcagtaggaatatgcatttatttgagtcacaatctctgtatgtcttaaagtccaattatttagaaattatcagaaaaaagtgcagttaatgctaaagtgttagcattaaccaaaccccataaaaccacaacagtaatgttttcttaaaacattgaattgagtcccgcttaacaactttgataatagcatgagatcagaaagtccttcctgaaaattccaagaatgaaagccgtgtgcatgagtttttgcgggagaatatttgcaacatttctgtgaagttcttgatagctagacttcctggtacaacatttaattgtagtccttagtaaacttttgtaataatttatgttgatttttcaataatactttcaagttttcaattttactaactcagtggaatactactgttggtatctattggtcacttacaaaaaaaaaaaaaacagtccgttgaatgcattttctttcttttttttcttttttttgttttgttttgttttattttttgtttttggagacggaatctcgctctgtcgcccaagctggagtgcagtggtgcaatctcggctcactgcaacctccgcctcctggattcaatcgattctcctgcctcagcctcctgtgtagctgggactacaggtgcccgccaccacgccaggctaattttttatattttagtagagacagggtttcaccgtgttgcccaggctggtctcaaactcctgaactcagacaatctgcccacctcggcctcccaaagtgctaggattacaggtgtgagccaccacacctggcctgtagaatgcatttcaatgtgcataacgctaatgaaaagacttgcagttttggttcagttaatggcccattgtgaggactctttaggtctgtatacttaggcatgatacattattgctgtaggaagttagagaagatgggaagcacagggcttccattctacagatatccctatattttttggcgggggattgactccgcaaaccatattttctaaactttttcatatatacttgcttatgaatatattggaagcaagcctatatttatttattattttattttattagttttttttttttgagatggcatctaactcaccctgtcatccaggctggagtgcagtggtgcaatcttggcccactgcagcctccgcctcctggactcaaatgattctcctgcctgagcctcctgagtaggtgggattacaggcgtgcaccatcacacccagctaatttttgtatttttggtagagacagggttttaccatgttggtcaagctggtctcgaactcctgacctcaagggatctgcccacctcagcctgccaaagtgctggaattacaggtgtgagccactgcaccctgccccaagctatatgtacactgtacctcaatatccatatatatatccgtggagatatatatatatatatatatcatccatatatatatatcatccatatatatatataaaatccatatatatatatatatctccatggagatatatatatatatgtgtatgaatgaagcacttagtaggagcttttgtgacccattattaagcaaaatgaataaagttcattaaaatgaaactgtatttgattgctttagagctttgattttttttttttttcttgaacaaattctgcagaaaagctaagtggaattatttaccacttgggttggatttttggttatccttcctatttaaggccacacccagcaatcctaatagagttgaatggctgtgtttttaaatacgcagtgattctattggactcatgccaagcagcatcctggattttctgtgcatcagtgtctatgtgtggattagcactgacatattacataccagccaatgtcctctgctctcttcatgtatgctggtttgcaaaaaaaaaaaaaaaaaaaaaaaaagtagaaaaattaaaaatgctgaatcccgcagaaagtttccactccccagaccaaactgtgtgcatagcggggagaagggaccagatggccagtgggttgaaatcagtggaaaaccagctgggatgcatgagagggcatttcctcttccacttccctggaagcctggtcggggcaagtcctggaggtctgagcaggacaagaggtgtcaatgtcatggcctctgtctggctttctggatccttagatgaattgcagttggattggaatttggcacaaaaatctgaggataagctgttagttttctgctttctggaaaaaaaaaaaaaaaaaacagaacaaaacatgccagcttgacagaaggttggagggtaaaatgctgatgaacaggaaagaaccatatttccctgcgttagcaccagcttggagaccgaagttctatgaggagggcacatgatttgggtagttttgaatcctaaaggcaggatttttttcccctctcatttaaagcaaaacctttcattgccactgaataattatgcatttcttagactgccagcttctgcaacagtgattcctaggccccagtttgacactgagtgtgttcagttattttgaggaaagttacaaacgtttcaaattctctcacctctaataaaggtttaaaatctgccttttatggtgcctttttctgggttaacatattagttatctatagctgcataacaaattaatgcaaaacataccaatgaaaacagctatcttttgaggtctctcctgatgttgcagctgagatgttggctggcgctgtgtcacctgaaggctcagccggggctggaggatgtctccaggctcacctgtgtgtgttgagaggcctgagcccttcagtggttactgatcagaagcttcaattccctgccacatgtgccatgatagagaggtgcttacagcatggcagcttttgtcctttagagcaagaggtagggagagagagagagtccatgacttttttgagatagcttctcctattaacatctgatctcagtgtggtgtatttgttacaattcatgaacacacgttattacattacatttttattaaagcccatagtttacatattaattcactctgttgcatgattctatatttttaatgttttattgtaaaatacacataaaataaatgttaccgtcttaaccattttgaagtgtatggttcagtaacattgaatacattcatattgttgcgcaagcaacactatcacccgtctccagaactcctttcatcttgcaaaactgaaactctgtacccattaaaaagtaactcctcattccttccttccctagtccctggcaaccaacattctactttctgtgtttatgattttaactactcttaagtatctcaaataagtggaatcatgcagcatatgtccttttgtggctggtttcttttgcttagcatcttgtcctcagggtttatctgcgtggaagcaagtgtgagggtgtgaattaatcattctttctttctttctttctttctctctctctctctttctttcttatttatttatttatttattttgagacagtcttactctgttgcctagctggagtgctgtggtgcagtcttgactcattgcaaactctgcctcctgagttcaagtgattctcctgccttagactcctgagtagctgggattacaggcacccaccaccatgcctggcaaattttttgtattttcagtagagactgggtttccttatgtggcagtctggtctcaaactcctgacctcaattgatctgcgtgccttggcctcccaaagtgctgggattacaggcttgagccaccacaccccacccctttttaaggctgaatgctattccattgtatgtatataccacagttggcatatccattcatcttttgatgggcccttgttgggttgcttccgtgttttagctattatgacagttttatgggtttggacaaatacataatgttacccatccaccattacaatatcatagagaatagtttccctgctgtaaaagtctcctgtacttcacttattcttccctccctgctctccccctgcaggttcctggcaaccactcatctttttcctgttttgccttttccagaatgttatatagttagaatcacatgatatgcagccccagtaggttttatgacctagtctcagagtcaaacagtattatttctgccttattctgtttgttagaagcaatttcatccttctttcagggggagggtaattgtgcttcactacttaaaaagctggggtggtggggagaggagatatcaaagaattttcagacatgttttaaacaaccatagttaagatgacaagactagaagtccaagcattcactgggcatctattctgtgttgggcactgttctttcttagtgttttatatgtactattcattcaacccttacactaatgccatgaggtcactctcatatttatcatccacattttacggatgaggaaactcctcatccgtatgtgactccctgaagccacatacctcataagtggcagagccaggatgcaaactcaggtcagcctgaaaccaaagcctaagtcttgaaattatatcacgctgttcccttttagtgtaaggggaagtcttagtctaaggcttagattcaggggacaaggtctgaccaaatacatcagaagacatcaatgggcgatgatgctaaacatcttccagttgcctctccaaagacattctttgtccttcctcagtgtgtagtttccattgctgctggaacaaatcatcacaaacttaatattgatttcctgttttaaagttctatagctcaggaacccagtgtgttctcacttgcaatcatcagggtgtcagcagagcttcttaccttctggaggccctaggaaagaatccctttccttacttgttccaacttcctgagactgtcggcattccttggcttgtggcccctcctccatcttcaaagccagcaatacgggcatttctggtcatctccacagtctcatctcctggactctctcctacttttttttttttttttgagacagagtctcccactgtcgccagagctggagtgcagtggtgccatctcggctgactgcaacttctgcctcccaagttcaagtggttctcctgcctcagcctcccgagtagctgggactacaggcacacaccaccatgcccagttaatttttgtatttttagtagagacagggtttcaccgtgttggccaggatggtctcgatctcttaacattgggatttgtccacctcggtctcccaaagtgctgggattacaggcatgagccaccgtgcctggccctttctcttccatttctaaggttctccgtgattatactggacctatccagatagttcggaatcatctccctatctttaggtcagctgcttagcaaccgcaatccatctgcaaacttaatttacacatttaatttacagatatttacaggtttttgggaataggaggtagagatctttgggaatgttgattaaaaaaagaaactctggaagatatttaaagaggtttgttctgtgccgatatgagtgaccatggcctgggaaacagtctctggtggtcctaagaaagcgtgtctaagatgactgggttatagtttggttttgtacgttttagggagacagaagttataggcaaagacaaatcagtacatgaaaggtatacattggttcagcaaagaaaggcaggacatcttgaaatgggggtaagtagcctgcggcttacagatcatagttggattcaaagattttctgattgacagttgattgaaagagttaagctttatctaaagacttgaagctggtagaaagaaatgcttgatttaagataaggggggttgtgaaaaataaaatgcttagccaggcttggtggcatgcacctgtagtcccaggtacttgggaggctaaggcaccaagaatcgcttgaacctgggaggcagaggttgtgttgagccgagatcacatcattatactgcagcctgggcgacagagcaagattgtgtttccagaaaaaaaaaaaaaaaaaaaaaaaaaaaaaaaaaaaaaaaaaagataaggggcgttgtggaaaccaacatcttgttacgtaggttaagctttcagatagcaggcttcagagggaatagatggtagatgtcttgttttcagatcttaaaaggtgtccgtctcccaccgaatctgtgctagatccagggaagtcctggctgcattcatggaggttcttcatagattcagaaaagacagctttgcagggtcatttcaaaatatgtcaaagaaacattttgggatacaatattttgatttccttcagagtctgctatctgtcatgcgatgctatatcagagtcaggttggaattgggtatcttattcccaaagagtctgttttgtcagtctaatgatttctatttgaatgctaatgctgaagtcagttgtgcctaaactcaaaaagggaaagggcataaggaggtgtgtctgacctcccttttggcgatggccagaaatttcatgtttcaggtttcccttggcccagggggagtctgttcagtcagttgaagagacataggattttattttaggtctcctgcctttcctgctcttttcccaggaagccagtatggaaggagaactccaggggctcttctgccctttgattgtcagctgagttctgcttatggggagttttggtgggagattggagggaggtggttaaatgataccaaggcttctattgtcctgtgtccttcctgagtagcagagaggaccggcctctgcttgctgtcactaagcagccagcctcctttccttctgggaccctctaacttttccttcacctcagccattttggcccagggaaaataattttgctgctactaattctaggttgctgcatagcctgtgtggtttcccggtgctctgcctacacctttgaaaacagtattctgtaagtaagatctccttaactaatcctaatttgagtatgccatctgtttcttatctagaccttgactgatacagtgactgagggtagtcatatttgaagttaaaacagaaaaaaacaaaacaaaacaggtatgtcttgaattaggctaggctaaatctttcaaagcgtgggacttaaccccttgccagagatgttgatgtgaaccccgaatcctaaggtgctgtgttgttttcagaagccaagtgaaatttccacatgaaagcaaagctttgtgcgttcttaaccaagaaggtccttaggatgtatacagtgttctctctttgagttcctcctggtgtctgttacaacagatgaggaattcaagaacactgccccttccatattcgcaagatgtgacaggctattgcccttgtcttagaagacctgttttaggttaaaaaaaaaaaaaaaaattcaaacaattccacaggtgagctaatgagctaattacagagagtggtttcaaaacattggcattccacaagtaaacagcatctgcctttgattaaggtgtgaaattttaaaaaggtatggaaagatggctagtatcttcaggtggcttcctttatattttttattttttgattgtgcggaaactattatataatggccttctgtgcattctcctgtgagaaccaggaaaaccaaataacacataccaagatcctacagtggcatgaggcgtgaactctgaactgcctgtctgggacacagcctggtccattgtctgcagagctagggctttctcattgttccctcatgtttctgtactgttcgctgttttacctttagaatgagagttccctctgcatacatgtagaccaactttgtaaaattttgagctatttgtgctatgtcagtggctctcactattgactgctcattagaatacaggaagaagttttaaaaatagccatgatgcctgggctgtggccctagggactctgatttgattggtcttggatggggctgttcttaagcatccagggttcagaccaacggaactaaagcagggcttctcaaattttaatgagcgtgcaaatcacccaagactcttgttaaaatgcagatgctgattcagtaagtctagggtgggacctgagattctgaatttatgataaactcccgagcgatgctactgctgctgacctgtggaacacacattgagtagtaaggagatagaacatttgggtgggtacagataccttttaaggatgggtgaatgttaatgcttgggtgtttggtgatttgaatcatgactccgagagttgagagttctctaggaagtaggaaatttgtagtctaatttggatgatcgaattacagactcagtggggtcttgagtagcaaaacacagccagacctcttcatatgccatcattgccacattaatgatgagtctgtttattcattcatgcattcattcattcatttgttcattcattcattcagtgaatatgtattgaatacctgtcagacaccaggcatcttttcggtgctgagaataaatcaatgacaaagataaatgaggttcttgaccttggctattccagtgaatggagtagaaatagattaactcaactaaataaatatgagtcaacaagagccataccgatggtgatatgtaccatcaatgaaatcaagtacactgtgtttccttaggtggaaggtgtggctacagagtttaatttgctatgtcaatggagcggccaatggaagtttcttggaagaaatgatgttttagttaagacacacacacatacacaaaaccccagggaaagaccattccaggaaaacagaaaagcagggcaaaggccctgaagtaggaaaaagattgatttattggggaacagagaagggatcagtgtagccttggtgtcatgagtgaggagatgagttgtgtggagaggtaggaagggaacgtctcatgcagaggataaggactttgagtgcttttctaagcaccataggaaggcgtctgatggttttacacaaggaagaggaacattctgatttttgtgttaaaatgattactttggctgctatgtggcagatatattagagatgaagatgtcaaaagtggacacagggaaactgcttagtaaactcacagagtaacccaactgaatgatgatgatgcctggtcctagaaaagtggcagtaggaatggatatactttttgtgataacactgacagatagggggatgaggaaaagggaggaagcatgaatgacttctagcaaatgcagaaatagtaatgatttactcacatggggaggatagctgaagatctaatttgtagggtttgacaagaccccagggctccattttagacaagtttgagatgcctgttaaactttcaagtgcggatttaagaatacaatgtatactcgagtctagagcttagggaagaattcaggtctaaaagtaggatttgaggggctattcctatattcatattaaacattaccgtattaaatgagttctcaaggacagagaaaagtagataccaagggaatattggggtttgaagaaaaattggcccaaggttagggaggcaactttggatccttcttgaaatccatcttggctttggattctcagatcttagactcaaggtaaccttgcagagatttcaataataattagtatgtaaactttcagtaaacattatttcccagacatggaacatctggccaaagtcagtgtgatttgaaatgaagtcggctttatctagatgtctctcccagagggacacattgtgaggaaacagatattacattgggtgattatggagggtggggaaataagcttgttggttccttggccagatgtctaagtatatggtaacggagttaatggatgttggggaagaaagacatgtgcagagttggcatcctttcagccaagccaggcaaggttgctgatgaaggacgcctgctgctgccatggagctgaagatatattctcggacccaaggaagaaacacagaggatgcattatcatatggaatgattagttggctaatgagccttgaggggcaggaaaaaatggactataaaacaaattaaaccagtacctgacatcctaatgttctttgtaaacacatgatgatgtcagtgtgtgtgtatgtgcgtgtgtttcctcctgccagcccatgaggttagccaaccccacacaaatactcagaattaggctgaccatctccccattccccaagtctgattcctgggcaggatgccgtgcatgaggaaggtgatttggcttttagagagatcctttccctgtggttgttcttggtagaggatgaaagatgagatttctctgaaaagctcatccctttgaattgtgttcccgaggaaagaggccagatgctatgtgaccaaagctttagaaaactccaggattttgggtgatgagcatgcaatgcctggctgtcttccatctgcagcaagggcagagccagcagggaatggacaacaatacagagaagaaaaggaagcagggggtgagggatgacttgctcacagaccagattatttcatccccaaatggaatggttcagagtgaatgaaatcaccctgatacggagcaggggatgctgatttagctaccatgacagtgccatagccactcttcctgtattgactacttactacgttcagacttgttttaaaggtttttcactcattgactaattccacaccaatcagagcagcatggagggtataccatggctgtgcctattttatgcatgaaaaaaataagtgtttagagagataaagtgattttcttacggtttcacagaccgtaaagcttggactctaggattggaactcaggcagtgacatgtctgcatgttggaggcacattttgctacgttatcaaggaaatactcagttattaaaaagagagaaggaaatgcctcatgggaacaaaggccaggatctaaaatggttttaatttaaaataaatacagccatttgtgttatgtttaatatgtgcgcagcattttacggtaaaattgccatatctgatttgatttaatctatataacagctccatggggtaggtattatgatcctcattgtacatttgttgaagctggctcaggaaggatccttggccagggtcaggcagttcagcttggctgagcgataggatttgagttcagacctttgtctattacacatgcccttcaaatagtattctagtcagatttctttccaattatcagtgcttctgcattatctataatctgggatgtttatttttacttcaagaatctctcataaagactggataccagaaaccttccaaattgtgatttctcctgttctgcccctgaaacttcattatttaatgttcccggtaataataatggacacccatttctggattaaagtacgtgccttttcaaatgatgcatcgtggaaaggttattattaataaaggtagcattaaaacaccacaaataactctgtaaccttgcttgggctcaataaattccctgcagaaaattttatttccagcaaacccttaaaatttagctcgcttttaatatactgtgaccttcagtggcccttatcattcattatatacgagtgacctttccaaagttgagaaggatagttgcaacagcttttggatattaaaacctataagaggtaggtatggttttcgttcattcctactgataattaattcatgtactttaaagacatagcgttattccttttatgacacaggtggtgatggtttcataagggcatggaatataaatggttatcttggctaaagtgggtttctgtcctttttagatgctgagttctagctatagcatgactcagactggggtttcccttggaaggagcaatgtcaagctgttggagacttgatcatcattttgatgatcatccttgtgccattttgacgatcgaccccttacatcttctaacagctttttttttttttttttttttccttttttgagacagtctcactctgtcgcccaggctggagtgcaatggcatgatctcagctcactgcaacctcggctttctggggttcaagtgattctcctgcctcagcctcccaagtagctgggattacaggtgcccaccaccatgcctggctaatttttgtatttttagtagagatggggtttcaccatattggtcaggctggtctcaaactcctgacttcgggtgatccacccacctcagtctcctttaaaaaaaaaattctttattaaataaaacttaaagcatatttaaaagtagagagaatagcctgaagaatcaccttctttgaatcacccagattaaataattatcaaggtattgctaatcttactttacatatgccctggccactctccctctctagtctcatgctactagtcttaagcaaataccagatatcatatcattgttttcttaaatatttcaggttgcatctctaaaggataagaaggtttttttcctaacacctgtaatatctactaacaattaacagtgattttatgaatctcaccactattaaatagtggtttaattttccaattttttcaaaaatgtcattgttttcttatttccaattctaaaaatagtctttatttttttacagcagtttcaggttcagagcaaaattgagcagaaggcactgagaatttgcatttccccttgccccacatttgcatagcttcctcctttaggaacacccttcccagtggtacacttcctatgattgattttatgatagtttgtttatttgaaacaggatccaaataaaggcagtacactgtgattgattgatatatctttaaaaggccattttactctgttaaaaaaaagcttaaaacgtttttttttttttttgagagtggaagtcttgctctgtcgttcaggctggggtacagcggcgtgatctcaaaggctcactgcagcctctgactcctggattcaagcaattctcctccctcagcttcctgagtagctggaactgcaggtgtatgccacgacgcctgactaatttttgtactttttaatagagatggggtttcaccataatggccaggctggtttcaaactcctgacctcaagtgatctgcccaccttggccttccaaagtgctgggattacagctgtgagccaccgtacccagcctgtattaagcatcttttaatcagtctttctcccatatttttgtgtgtttgttttaacatttttctttgtggtgattgttgaccttgttgaagaaaacagattgtttgtcctgcagtatttctcacagtctggtgtttgctgattgcatccctgtggtgtgatttcacatgttcctgtgtcctttgtattcttttaaattagtctaggtcagatgcaagttccatttctttggtcatttcttcttccaagaagaggtacattgatcgattgtctccctttttgtggtgctatttaatctccatgggctaggtattattagctttattctacatgtgatgaagcatccattgaccatggatgctcaatgcatttttcaggggttgcaatttagtgacactgtaattttacccttccttcttcatggagttaccggagtacttcttaaagagaaatttcccagtctactattaggatagtcagggggtatagtttatacaggaaatacaggaaaaatgcttgattttctctttgtgatttcaaatatatgagcttgtttatttgcatactctagtgactggaatttttggttttactacaaatgcagggatggaagttattatctttgttgatgctcagattattcaatcatcaaccggtgagagcttcctccttcctcaagtttctgcagaagtcattttgacatgactctgcttgtctttggtggctttcttactatctagtatgacttgatattctagattcatcttgtatatttgctaccccacacctgaaataatccatttccccgaggagatctgttaggttggtacaaaagtaattgcagttttttcccattaaaagtggtgacaaaactgcaattacttttgcagtaatctaatagttcctaagggtatttcaggatcataacctgggtactagaggtgtcccatgaatcttaaaagagtcttatcatctgttcccccaaaaaccacctcctccagttaccatcatcttgataatcggcctctccatccatcctggtactcaggcaagagagttcagagttttctttctttccttttttttgagacagagtcttgctctgttgcccaggctggagtacagcagcatgatattggcttactgcaacctctgcctcctgggttcaagcgattctcatgcctccaccttacaagtagctggaattacaggtgccttccaccacacccaggtaatttttgtattttttagtagaggcggggtttcgccatgttggccaggttggtcttgaactcctgacctcaagtgatctaggtctcccaaagtgctgagtctctgtcacccagactgctggggtgcaatggcacaatcttggctcatggcaacctctgcctctcaggttcaagcaatgttcctgcctcagcctcccaagtagctgagattacaggctcctgccaccatgcccagctaatttttgtacttttagtagagacagggtttcatcatattagtcaggctgatcttgaacccctgacctcaggtgatccacccaccctggcctcccaaactgctgggattacaggcatgagccaccatacctaaccagcaagttttcttttatttatctttcttccttccagtccatcctttgatttttctttccagttccactgccagagtcagagccctacactccctcacctggaccgacaagtttgacgcctaataaaatggacttctagtcttgctctctctagtccagtccccatcatgccaaacaagcctgttttatgaaaaacaaaacagaacaggaaagcaaaataaaaccaaaactggtcctgccatgcccttgttcagaaatgttctgtggctttctgctccctagagaacaattcaacgctgctccggttcttggtgtccctccgtttccagtcccataacctgcttcttccttccatttccttcatagtagggatttatccctaactcttcttacttcgttcctgctgctcccatgcctgatgtccctgtattcctcttcccccattttgcccaaggtcacgcagaaatttatgccaaggctctcttcagatgattcttttttgtgatgacttccactgaccttggccagaactgcttattcccttgattttatttctttaacgcacagtttgcttagtcaacctctatacgccttggtatcctaatctgtaaagtggggaacataattataataatgcctaggccgggcgcggtggctcacacctgtaatcccagcactttgggaggccgaggcgggcggatcacgaggtcaggagatcgacaccatcctggctaacttggtgaaactctgtctctactaaaaatacaaaaaattagactggcgcggtggcgggcgcctgtagtcccagctactcgggaggctgaggcaggagaatggcgtgaacccgggaggcggagcttgcagtgagccgagatcgcgccactgcactccagcctgggagacagagcgagactccgtctcaaaaaataaataaaataaaatataataataataataataataataataataatattaatgcctatggcctggggttgtgcaggtattagatgagatcgctcaagtaaaatccctaggagtagggttgggctcctttgtgagctcttcataaatattagttcatcatcttactgttgttagcagtaataatgtttgcagtggtaacatttctttacatctctattaatatcaccacatctcagtaattttacctggatcttgcattttctttaaattgggaagtttttcaggggaagggtctcatcttagcaattcttccttttaacacttggggctgagcggtaccttacacacagtgaggcctccgctattatttgcaaatttttgtgccatggatgtagcagaaattatccgagggctcctgatgtaactcctgcccccaatcttgcatcttagctggaaacaataaataacggaataatattgtctggtaccaaagggtgtcccagagcaggaattgcgcagagagcttgatgaagcagaaagaaggaagagtggctaacacaattagtgagtgtctggccctgaagaatggattgtattggacagaggggagaaaggggattgttctaggaggagagagagtgataaggtaagtatagaagtaagaggcagctgtcactgcagtggctgaatgtaaacaaagaaaatcatttagttgaatattagtgagtcaaatcaagaaaattcccatgtaatataacaagttttaggaaatgactattagtcacagttttatctaatggggaaaaatactgtgttgcgtaaatagtcataatcaccactattccagataaagttaaataaataaaacatttttctgcttgtaatctttccctacgtacataagagatcttcaggtcttaaatggcatttccagtgtcttagtctgtgcctcacttgtacaatcttaatgggacccccttaggctgggcacagtggcctgccccatacctataattctagcactttgggaggctgaggcaggaggatcgcttgagcacaggagttcaagaccagcctggccaacatggtgaaaccctgtctctgcaaaaagtgcacaaaaattaagcatggtggcatgtacctgtagttccagctactcaggaggctcaggtgggaggatcgcttgagcccaggaggttgaggttacagtgttggtgccactgtactccagcctgcgcaacagaatgagaccctgtttcaaaaaagaaaaaaagaaattaaatttaaagaaagaaataaatggcaccccttgagtgatggctgtaattgaggaaactgtcagtttgaagcagtggaggaagctaaagttatagtatctttcctaatagggtaaatttttgtttcatattttatttcatcctgctctgcttattaggaaacataatataatatgtttttttggggaggcagggaagaattataataattatggataatatttcaatttatgtaaataatagttcaacataaataatatataagtaatattctaattctgtaattacagcagtgggtggtatgttttgaggttttattaagtatcaaccattgatttaaacacattttgttgaatcccctaagatctccagcgtcaggtttcctgtctttcccacttgacagactaactccggctttgagagtaaatgcgaagtatatcaggtcaaattaagtctcaggtgagatctgtctcctgaaagataaacactgggttgacaccctgaccatgattcatattgggtctatggaggtgcaaactggagaaaaaaatcatgagtttcttcttgttgtcgttggtttagaataagtcactgtaatgaaaatccttcttcaaattttgtgtttctgtatgctgttgaagggaaactcacagatttgcacacatcttcacataagattcatcggtggatgttatgctatattggctactttttttattattattattatttttgagacagagtctcactctgttacctgggctggagtgcagtgacacaatcttggttcactgcaacctctgcctcttgggttcaagtgattctcctgcctcagcctcccaagtagctgggactgcaggtgtgtgccactatgcttggctaattttttgtatttttagtagagacggggtttcaccatgttggccaggattgtcttgatttaatttttagtaaatattgtcaggtgtccaatgcagaatcatgtcatgtgaggctgttcctttgcaggggacttcatgtgagggtagagtgtttcttgtggcatcttttttgggatgcaaaacttatcctacaggtcatttatagtattttggaatgagtaaaggctttttgctgtccaacggaattattaaaaagcacttattatctttctcattaaacgagtcatctgttcttctttcaatgcacttgtgtcaagtgagtatgacatgcaaggatttggagatacagaagtgaacaggcattgctgggcgcggtggctcacacttataatcccagcagttttcaaggctgaggagggaagatcacttgaggtcaggagttctagacccgcctggccaatatggtgagaccccatctctactaaaaatacaaaaattagcgaggtgttgtggtgcgtgcctttaatcccagctattcgggaggctgaggcaggagaatggcatgaacccaggaggcattggttgcagtgagccaagatcgcaccactgcactccagcttgggcaacagagtgagactccgtcaaaaaaaaaaaaaaaaaaaaaaaaggacgacgaattggacaggcacagttcctactctcatggaagtttgcagtctgagaagcgagacaaaaaaaagtgaaatcattgcgataaggaagtgtgaagacttcagaaggagcgatcacccagcacaaagctggagcaagggaatgaccaaagtaagatgagtacagtaaaataaatctaattttagtttattatagaacacttggcaaacacagaaaagtacaaggatgcaaattcctcagaatcccatggttacagtcaccttgagcattttactggatgtttgattttactaatcccctcttgatgagcacttaggttatttctttcctaatatatgaaatatctcctaattttgaaaatgtttcctctgtctactatgtgatagaatttgtttcatttctttgcactcaatgagggttcttggggtgggatagaggggcaaagtgggtagtttgggtggagctaaacaaatctaagtgatgccagtataaacggcgggaaaatatctgtccatagctgcttgtcatttttgtgtcagctccccaaggtgtttgtcagtgtctctaatctccttacactgtggtctcgcctgaggatttgcatattatggacaaagtgaatgtgggggagtgtagggataaagcaaggaaatttgacatttagctgtcaacgatattgtctttcaagtgaggttttggaatctggtaagcaaaagattctaatgagtttgaatgaactgatgagtgtaatacctgttttcctttctcttttcctcgatctctcattctgtctcctccctttcttcccctaccccttttctctttctgctttacccatttgtgtttgaatactggatctttatcaaggtcacattcatatatctcaagcaagggaaaataaaaaccttgtaatttatttatgcatgtaattgcctggcctcattccttttttatttctcctctgcttacttcctaattcctggtgggtctatagctgttaccaggagaggagactggcgtggtcgctgaccaaatcaatgaagatactcctttagagacaaagtttacagttcttagttgtgataagcattatgaaaatctaaatgaaattgtctaggagaggtacattatgaaatcacactcccttttgagtgttaatatggatcaacagtgataaatatttgagacactggttgactggacatgtgatgaagacttaagacttttttttttttttcttttttactctggaagtgagctgcatacagaaagaacaaagacggagtgcagattaataaccaaagtcctgatgtggcaattgattaaactctctttttatgatacctttcctctagagtgaaaagtgagtttgtgttcgtgaatgccctggtgacaagagtctctttttccccgaagaaagagattcacgtatggctgaaatttcccggagaacacaggaggggggggaatattgcaataaatcaagtgagtttttgtgatccctataagcaaaaacatacttcagttatgatggattgtgttagagagtaaattagattgcatggaggctaagtactaatgttgatatttacagtgcttaaatatattgtctgcctcctctaaatgcagctcattcattggctttatgttgtggaggaaatatcagaataatgacctgggttttttttttctgtctttatagtttaatatcatgcaactgtttattaataagctccaaaccccaaaggatccttctaatcctattctaatatcagactaaatttaataagatgcattcttctccccactgcttatgcctcattcattcatttattcaaccaatatttattgagggcttcccaaagtgacaggcctgggttaggctttgggaatacaatgttgaaacacgacaggcttggtctctgccaacaaatggggacagaccaaaagggaaaaagaaaaaaaaagaccaaagacactgagccaagaatgccgccaggcgtttaaggatgtatattgtttctctaatgtaatgacttcgagatttttgggagagatgagagtttagaatgcttgaagatgttggtgtccttggagtgcaaggattatctcctgggataatggaggggaaatttcttgcaattttctcattttgccaagcccccacccctggcactgttgaaattttatgagggtttgctatgggtttttttttttttttttttttttgaggcaaacataactttgttcaggttaccagaagtaggcaaccgctcagttgaattccagattcaggacaagatgtcttgctgatggtgaggtcaaagatgaggggaaatcttcagagagaaagcaagcctgaaggctgcacttcagacaaaggcctgacccgggttcttcacacttgaaaggatggcagagttcaaaggaggcagtgccaaaggagcaaacgcagacacacgggaaggcttgtgaaaagggtttttatttgaagtagagtttttgagcacgtgatggggtcgggggtggaatggagaaatgcaagtaacatgcttctttatcacagaaattctcatcaaagtcatttcctatcagaaatatgagtgtttattggttttcattaatccctgcccctattctctttctagccttcctttcctccttctttccctgccttcctccctcctcttcttcctccctcctctccttcctccctcctctccttcctccctctccttctcagatgtgaatgtgttaaagatccaacctttgctaacttcttgcactggcctagaaccatcttttagaccgtgtcattgtttatgctggtttagatctttaaagatacatctttataaaaagttataacattcttgatgacatcgaagcatttccagaaaatatcgagatccgtcttatatatctgtttattcatccatgcatccaccatccatgtattcatccatctatctacccacccatccacccatccatccacccatccatctacccacccatccacccatccatccacccatccatccatccacccaccatccaccaatccattcactcatccatacattcacccacccatccacccacccatccaccaatccatccacctatccattcactcatccattcattcacccacccacccaccaactaattatttacccatccatccacccacttacccactcatttatttatccatccatccatccatccatccatccatccatccatccatccatccagctatcatgtatacagtaattaaaacagcaccattttgcagagttgcttcactctagctttcttttctgtgaatctggaacaactaactcagactctgtagctggaaaaccaagaaaaatgaatgtgaaagaatgccacatctttgcaaaagcaaacaccaccacatgcactactattaatagactgctttctcttttcatattcttcctgtgacagtcataatttgcatatatagggttaggtttggcagaaaggaaggtagaagaggtgaataattcatctggacttggagtaaaggttttaattttctcttgaattcaagatgtcttttggaaatgaaggtggctctgaaggaagatcaaaacaaaaggtgagcaattctgatttcttccctaagcagtggccattataaaaataaattaaacctggagaactgaacaggagtgcgtggtatctcttgtgcaagagactagaatagggtgatttatatagagatgacctaatcaaaatctctttaatattattgcacgcaatataaacatttatataataatttatactaaagaaaatacatataacatgtatctcatattttgtttcactttaaccttctatttactctgtatatttaaatgtatttttaagtgaaaattagtgttttaaagggaactattcaaagttcattttcgtctatagggaggaatgcatgtgtttaaatgggttctctgagtaaatatatttttgacacttgaggttattcaaactgagcatctctcagttttaggtcttaagtttcttccttcttctatatactttgttttacttttagaagctgaaacagggcctctaccatctgtttatctatttcagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaataggtaactggcatcatttggccctaaaattaggattagggttttttttttttttttttttttttttttttttttttacgtataacaagaatggagaaacatcttgcttactaattggaaggaataagtttgttgctacaacgtactgagttttggctctcaaattctcctcttcttagccacaatttggctcagaggatttgcaccatttgttcatctgtaaaatggtgataataatagcagatactgtctaagtcttacagtgagatttaaatgagttaatagatataaaacacttacagcaatgcctagcacacagtaaatgttctagaagggttagctgtaatttttggttattatactcttaggagaagcttcctacaataaccttatgagacctgctctccttgtcatgcttttggttgacctttcacagagtgtattttcaggttcgacctctacgtcagcagttccatatactttgatgcttgcttcatgctttgcctatggtgttgtaaacaggagttctccacatgcatgtgttgctaagcaacacagaatcctttggctgcaagtaacttcaaaccactcgtactaccttaagacaacaaaatatcctagaaggactcagagctgtttcccaggattcaggggcagagagttcagtcatagaacccaagaggaggaagttcacacagttaccccagaagaactgaaaccaggaagggaacatctacaggagcagagattacactgtttttccagggctgcctggggttggtgtctccttctgtctgtgccattaccttccttttctctctgtagatttctttcccacatatggcacatggacacacggggctgccctgaacccagccctgcctactgcagtgattacaatccatgcattcatttacagttactgaggacagaacctggttggtccagccctgcccaccacactgattacgacccatgcattcatttacacttactgacaacagaacctgattggcccaggtcttttcagaagtcacccctagtccaatctgctggaccagaggagggtcatggttgctaacccacccggcagcagatacaggggtggattctatgagaaggacagggacccactatagcaattgattaatagatctagaaagtagtgtgcgaagttaccaaacatatatgcccaaataactaagctataataagcatgttcatcacttcagaagacacaactacaaccaatgggtgtaagcgacaagtggtcagatttcaagtctcaaagaataaatatctgaaaatagataattttcattatatgtctatataatgttttgttatatatctatattgtatatgtatagtcatcatatatgtatacatctattttcattgtataacatataatggtaatatagtatattgttacaaatatctgaaaatatataatgtaattattaaattatatgattatactatacactatagtatatgtgctatatttactataataaaattaagtatagaaaatgaaaattattttcagaaatttattcttaacaatataaataaatctctatggataaatctatgtacatagatttaagatatactatcatacatagaaaaaaacagtgttttcactttacactcacactcatatagcacagaatacttctgtgaccagatgtgcagggttttccccatcaacaaccagttctccagcagataccaatggggtgtcctataattcagtgccattctgacattatctacctggagatagcatcagatcccacagattaaggattctgccgccaagactgcccccactttggactccagttggaagcctcaggttgtgacctgtgcttctgaaggactggttaggattcccatgtcccttccctgggtttaagttgatcgagtggcttatagaactcaggaaaacactgacgtgcgtttactggtttattataaaggatattacaatggatagagatgaacagccaaacgagatgcatggggctgagcatgtggataggcgtgcagagcttccttgccgtctctgggtgcatcaccttctaggtagccccactagttaagaagctctctgaactgtcctttcaggtttttatggaggcttcattaaataggtttgattgattccatcattggccattggtgatcaactccatctttagcccccctgccctctcaagaggtcaagaggtaggacagaaaattcctaccctctaactagaaggtaggtccccctggcaaccatcccccatcctgaggctatccaagggtcccagccatcagtcatctcattaacatacaaaagatacccttatcactttggagatcccaatggttttagaagctgtgctccaagaaccaggttcagcaaccacatacatatttcttataaatcacaatatcaaattatatatttgtatctatatatgtatatataacatatatatctatagagattgtatatatgtatatatgttacataatatataaatatatataacatatacatatatacatatctatatgtatctatacatagatatatatctatatatgtatatatgtatctatgcatatatagttacatttatatcactatctcaagacatgtatctctttgactatcactgtgtggagatatttactcttaggaattgtctcatgtgcttctaggggcggcaaatatgaaatttgtagggcagattagcaggctggaaattcagatgagagttgatgttgtagtcttgagtctgaaatctgtaggccagctggctggaaactcaggcagaatttctgtgttacagtcttaaggcacaattccttctccagaaaacccatctttgccctgaagaacttcaatggattcagtgaagcccacccatatttttcaaggtaatctccctgacatacagtcagctgtgatgatagatgtcattcacatctgtaaaatactttcacagaaacacgtagatgaatgtttgagcaaacaacgggacaccaccacctagactagttaacacatacgctgaccatcccagcatcctttatcatcttgatgagcttgatcactttggagcagcaagagggaaagaaaactatcaaggcagaggctgccatgatcaccacatgatatgccaacttgctaagacattgagtttcaattgagtctcccaggccaggctaccttcctcatgatgaggggaacagggaaatcaatatgggttcattaacacttaatttaggttttccagtgtggagcatatcaggaagagaaatggcagacatattacttgtctcaagcattatccatcattagcgtctgttctctttctccgacacacacacacacacacacacacacacacacacacacacacccccttatatttttcccctagtaccttcctcactgatcatattgttctgttaacacccaccaccaaaactacatcctgggtcctctccacactgcagctctcaagacgatcgtttactctattatcaagcttaccatttattttattttcaggcggttgtattcattataatgccattagcatgagaagtggggtcctgtcaccagggcaaccaggagcacagagtgcacattccctccttagctgatgtcttgttccctcttgggtggactccaactgtgtctttgattcattccattaggtggtcactgggatgtagatgcttgacagcctccttgtccttaagttgtctgtctttatatcctttactggccaagatttctctctccagaattcattaatttattaccttttatttctgtaagcataacacatataatatttccaagcatatttaaccacatgattatatctttacaattcctataacctctaaccctctaatgtattattttatattacatatcttggtgcatttccctatatattgtacatattgtatgcgagtatgatacattccccttttggtcagtactaccaattaataacaagctccttactactgaaggtatttcagctacatgatcatctgtctaggatattatagagcctattcttgcattatgaaaggggttgaaagagatgacctatacgttctttaaaaatctgaagccctaggtttattccatatctataactgtcctccatgaatataattttagctacagtggatctctctaaatgaagacatctggagcattccaaatgcaagcatgagtgcaaaatgtctgcttgtagttttctataacatccttcctacctccacaaaattacttagaatttgtgaataatttcattaaatttatctttggggggatacttgattaagtagtactccaagtgggcaatgtagtaagcaaatccattcccacattttcttttcacataggcagaatacatacaattttcttttttttattattattatttttttagacggagtgtcgctctgtcaccaggctggagtgcagtggtgcgatctcggctcactgcaacctccgcctcccgggttccagtgattctcctgcctcagcctcccaagtagctgagactacaggtgcatgccaccacacccagctaattttttgtatctttagtagagacggggtttcaccatattagccaggatgtatacacacaattttcagaaggtcttttgtgtgtatgcttttgaataatatgcccctggatcttgcccctccatcaatgatttccaaacctgacattgtatttgaattgcacacacacactaacttggatgtagaaacatttcagatctcaagacatggagaatccgaatcaacaggtcttgagtaagacccagtatctgtaattaaaaattaaaaaaaaaacctccctacgtgactgtttttctatatatttcttttctttctttctttctttttttttctttttcttgagacagggtcttgttctgtcacccaggctagagtataatggtgtgatcctggcttactgcagccttgacctcccgggctcaagtgatcctcccacctcatcccccagagtggctgagactacaggtgtgtgccaccatcaccggctaatttttttttttttttttttctgtagagacaggatcttgctgtgttgccacggctggtctcaaactcctggtctcaagcaatcctcccatcttggcctcccaaagtgctgggattacaggtgtgaaccaccgcacgcggccctatgattcttatggatgcctaggaacactggggatgtctgttttcatacagctggtggtcacagtttcagtgctattgtgtgttcttaggtggtttgcttttcttgctggctttcttcatggtcatagatcatttcaaagcctctgatatatcattgcggtttccactcagtcctctgtctgtttcattcctaattaattactttgacatgcccgtaacctgctcagaaatcactgggggtttcttagcagatacagaaacaaatcttcatccttcaaactggatttcacgaacctccaaagtttcatttctcctcgtctttgagatgtgatataatgtggttagaagacctggctttgaattctgccccttcctctgtagacctactaagttccagacagtgtctctgtatcatctcatgtaatgcttataacagcctcatgggatgaatatccccattttatagatgagaaaacagaggctcacttagctaaaatcacttaaagcctcagtagtccttggggtctggattttgcctccgaggactagggttgtcctcatatgaagtgattgcctgccagtgtcaacagaaggattcctagtcttgataatttggaaagtgcgctaagcatgagatcttgagatatatttccgacttcaacactttaatggtagtattaagaggtataattgctcatgcctgtaatcccagcactttgggaggccgaggagggtggatcatgaggttaggagattgagaccctgctggccaacacggtgaaaccccctctctactaaaaacacaaaaattagctgggtgtggtggcatgtgcctgtagtcccagctacttgggaggctgtggcaggagaattgcttgaactgggggggttggaggttgcagtgatccaagattgtgccactgcactccagcctgactacagagcaagactctgtctcaaaaaaaaaaaaaaaaaaaaaaaaaaaggcataattcagacgtggcagttgagagggtaaatagaaagcactaattaaaaaaaaatccaatttctaagactgcagagcatcagctattattgaaaatgtagacatcagaagggaaaaaccctttgttcagatacagtgctgctaagttagatgcagctgagaaatgggaatacatgcagtaaggtggttatgcagtatttttcaacagtagtccacggttgagcatggatgccatttaaatacattatctggaaaaatgtacatagaacttacgatttttgacagcaggaactcattatgccagaatttggattctcaggatagctgagcagaaagggcaggtggaagtctcccgaaatagatgagtgtttggacaaaaatggcagcaggtatactgtgccaagcattggcctttgcccaggtgccgggtacgatgtcaaggatgcaagctgaagctggccatatggttctcagagtctctctgctcattctgccctccactcagaggtagagacatgggcttttctttatttgcagcagaaggtaattgctttagacttaacaggctgcatttgaccgttgactcaccattatggtgtattatgaaatgaagcctcagccttggtctcccagagtagggggcgggggagggcggcagggagaaagggtggtgcctgaactatcaacacggcacagtttaaatgtcaggctctgcaatttacaagtgatctgagattcatgggaaatgcaatggaaaagtcactgccgagtccctctccctcatgttataagattgagtgtgtcataaattttgtgcattgctaagttcatggtgcttctgtaagaagacattaaaaatagaactccttacgtcctcgattcttacctacagggcatgcaggccaaaagtctacacacagaagttaagctggtttttaatcctgtttttcgttctggggctgtactcttaaaagccaaacactttttcagagacattctgtgcccgatatagcttcattttgttaatagcagaagtgaatagaggcaaaaacaaaccaaccaaacaaacaaacaaacaaacaaacaccctgaaaatacaagcgaatgcctggataggaattcaaagtttcattgaaaataagatagaaataaatcactaaccgtacttgtcttacctgtgtgatgtggatattacataacttaatattaggtagaatatccaaactattttgatgaaatatgttgggagagagagattttttgtttcatcagagagaagttttgcttttccatgaaggtacagcctcagcttccctagagaaatctttctccatagaaggaattatctgcaaagggtgggttgctgagggctaaatccattaaaaccaatttgaggaagagctgttacttgctgaggatgggaaaaaaatatataaaaagctcattacctagagcaaaatgattgctttaggattaagaaattgacagttactgtttaattataccagcccactgaaaactcacagactaagctttctagacacttaagcatatgtgcatttgttattgtagcaattggggtaaatttatgatcataaatgccaataacttgaacagtatccaactagcctttgtgtgaataggtttattgtgttcattttacagggaaaacacagtctttctatcaatatgaccaagatttcctcgattttcttttattctcagagttctgtttaattgcctgcaatctttttgatattaggctcttcattcatttttttgtccattagtagtttcactaaggaaacatggttctgtagggatgcgaggctgtgtttcttatacgtctgctcccctttgggtctgagatcatacatacctggcttgtggtccagtgcaagctccctggcagcttgggaaatgcgtcttcagcagacttcagccttactttgttttcaggaatgtggcaggccaggtcgcactaacacagccttctgtaacaactgtctcagtgctgactgagtagttaaggtaaatattaaaagctgagagagccagtgcctttatacaaaggctggagtgtatcaaaagcctacctagagttgtgcctaggcctttcctgggccttgaagcatgacaaaataatgaaggaattcttaataggaaccgtttggggttaaacaagttttattggggttgtgaagatactccccaggtatccacaaacaagtttattcggggtttgaagggactccccaaacctccatgatttagcaggagacaagataaggataatcatcccagcacctggacccatttagattaagtaaatttactgaggctgcagaggaaggtcttcaggactcagatcttatagatgagaagttaatcacttacgtctttagaggaatgcacacttacaggtagacatatagcttagaagctgtataagctctggaaaactttctaattttaagttggtctggtgatatttcccaggccttctccctgtacccggttacaggaataaactcccttgtctcccagttcacctgcatcttattttggggcagtgagaataagcattccgacactcagtttggcccgggaacaggagggcaagacagcttttcttttgtttattgctttgttgcctgctacaaagtaggcgtttaataaacatatttataaaaaaaagaatgaaggaagggagaaaggaagggaaggagagaaggaagaaaggaagcagaaagagaggaaggaaggagcgagggaagagaaaaagaagggagaggccgggcacggcggctgacgcatgtaatcccagcactttgggaggccgaggcggatggatcacctgaggtcgggagttggagaccagcctgaccaatatggagaaaccccgtttctaccaaaaatacaaaattagctgggcgtaggggcacatacctgtaattccaactactcgggaggctgaggcaggagaatcacttgaacctggaaggcggaggttgcagtgagccgagattgtgccagtgcactccagcctgggcaacaagagcgaaactctgcctcaaaaaaaaaaaaaaaaaagggaggggataaagggggagagggagagaagaaccaccctactaagttgaagaaagctgagtcctgccttccccatgtcatgccaacagattgtgtctcttaaaagagataaacaagattaattttggcattctttattcaaaaggacctttagactcttctttctggagaatttcaaggtcatataaaccttccgcaaacttagttattttaggaagtaacagaacatttcactgcaataatgaagtggttataatcttacattaagtaactaagtagaagaaaattggctgggtgaggtggctcgcacctgtaatcccaacactttgggaggctgaggtgggcagatcacttgagttcaggagtttgagaccagcctggccaacatggtgaaaccccatctctactaaaaatgcaataattaggcgagtgtagtggtgcatgcctgtaatcccagctattcgggaggctgaggcaggagaatcacttgaacccaggaggcagaaattgcagtgagccgagatccaaccgctgcactccagcctgggtgacagagggagattctgtctcaacaaataaacaatccccccaaaaccaaacaaaaagtaactaagtagagtaaaatctactttcataattcaaattccatagaatggttttgtttttctttaaattctattgttttagaaaactatacattttttaaagtgtgatttgactagtaataatatgagaactttgtacaactaaacttttcagaaacaaagctgttgtacaaagatatgccatcatccctggggagattttgagtaaatattctgtatgtggctcccccaaagtatctaaattcatcctaaaaataatttcagggaagacgtcatgggagttaataattagggttgttattagctcttagcgttgagcattttaaaaatccagtgagtgcctgcattatttcatacacttcagattatctgccttttgcaaacacagctgaatgtagttcatcaaatttgggtatttataaagataagcatagcccaaactttcgtggttgctagggcacactcaaatatcccatttcaatgaagtctgacaagaagtcactcttgtttttagattagctctggtcacagaaagtaacacagaatgatacaaaacagcccgaagaagcagctggctatggagaggcaaattcataggtgcctttttttccttgttaaactgagtaatcaaagtttagcttttctaaaaaaaaaattcctggaaacatttgctcatatgctgtataacacaattttgaccctttatcattgcaattcataataaatgtattttttgtcctctagtttccccaagaagttagctcctaggtaataaaattatacacacacacgctcgccccccccacacacacatttgcactaaacttctttacaaagaatcatttgacagtagccgtataatttaatgtttttcatctaatgctcagaatgaagcacaatatcaaattatttttgaggttttcatcttgttcctctgattttgattagtgagcattttctataccctagtcactaaattgaaagggatcaccaaattttatacatgctaaatggaaattggctgggtgcggtggttcatgcctgtaaccccagcactttgggaggctgaggctggcagattgcctgagcacaggagttttctaccagcctgggtaacatggtgaaacctcatctctacaaaaatacaaaaattagcgggacgtgtggcacatgcctgtaggaccagctgcttgggaggctgagatgggaggatcgtttgagcccaggaggttgaggctgtactgagctgagattgcaccattgcactccagcctggatgacagagtgagaccctgtctccaaaaccaacaggaaacaaacaaagaaacggtaatgtaaccttgacatgtaaagggcagaaaagaatttttacaaaagatattttattttaaataaaaatgggtactaggtcgaatacttgggtgacaagataatctgtacaacaaaccccaataacatgagtttaccgatataacaaacctgcatgtgtagtcctgaacttaaaaaaactgttttaaaaattaatgcttcatttggtaaatcaaccaagatagctgcaaattagtctagagtgaaaaattgataaacttaaaaatcgattaacacattttaagggcataatatgatattgttgactataagcactacgttgtacagtagatctctagaactaattcatttcacacagtgtaacttcaagctaattgaacaaccaccgattgtcccctccccgtggctcctggttaccaccattctcccctcagcttctatgagcttgtctattgcagacactttgtataagtagaatcatgcaatgtttatccttctgtgactggcttatttcactagaataatgtcctccaggttcataaatgtacaaatgtcaggatttccttcttctttaaggctgaataatattccattgtatgtatacacgacattttcttcattcatttgttttagtcagttctcacattgctaataaagacatacccaagactgggtaacttacaaaggaaaagaggtttatagactcacagctccacagggctggggagacctcacaatcatggctgaaggtgaaggaggagcacaggcacatcttacatggctgcaggcaagagagcttgttcaggggaactgccctttataacatcatcatctcatgagtcttattcactatcagagaacagcatggggtaaaacccacccccccatgatccaattacctcccactgcgtccctcccaatacatgtgggcataatgggagctccaatttaaggtgaaatttaggtggggacacagccaaaccatatcactgttcatctgtcattggacacttaggtggcttccatattttggctattgtgcttaatgctgcaaaaaaacataggagtgcagatatttctttgctatcatgacttcatttctttgtatatgtacccagaagtcggattgctggatcacctggtaatcacatttttaaatttttttttgagaaacatttatactctttttccatagtggctacatatctacattctattcagcaatggcaaaagggttccagtttttccacttccaggccaacaattgttttttttttttaatttttcatttttttgataataggcattgtaacaggtatggggtggtatttcattttggttttgatttgcatttccctatgtttagtgagctgtattatgggcttaaaatttgctaagatttccctttgttaagtgttcttaaccacctccatgttaagatctcatagtaaatgttcttaaacaccctctaccccactccacatgtccaaataaagggaaatttttggatgtgaaagataggtctgttcctatgattgtggggatggtttcacaggcctatgcttatgcccaagctcatcaaattgtatacgttaaatatgtgcagtattttgtgtgtcaattatacctccataaaaccataaaaatctataatattcttatgtgaaaggctagtgtatttatggacatatctcagacacattttgtgactagttatgatgagtcagaatttgcatctaatgaatttctttaccagtgttgtaaattctcagaattagttacataccctaatatctaatgggggttggccacaagttgataactaagccttcatcccttaatatcatctactccactgacttccagggctgagatgaactactcacagcatgcatatttaagacaaaaatgactctgatgagcaggtattaggttggtgtaaaaggaattgaggtttttgccaaatatttttgcaccaacctaataaaattctctcttgtatctgggatgggtcatgggccccagagacactgtaggtacttctatctcttaactttgaattagttcaatctaatgtggcatttgggaactgaaaaaccaaggaagttcattactgctattattattttttccaagtgtatgctaataggaaaaactgcttagcccaaaatacgtgtagcatgttgaattagctgaagcatttcccccgtgtttgctttagaacgtaatacacttccgttttggaagtaaaatgacaaatttttggtgcacaaacatgttaaaggctattacagaaaatatttagaatgcataatcttcctggattcctattttattgtaagtgtataaattttaatagagtttttatattagttgttcctcccaactaattatttttaaattgctggaatgttttgaagcagaaccataaaaggtatatattttttttatttgatagggctctttcaactgcaggtgatagaaaagcaattcagcaaggttaaatgaaatagaaattggtggagggcctggaggtgttacactatgggtactggcttaaggcacagcatgatccaggagctcacatcagtgtagtgaaggttcttttctttttctgagacagagtctcactctgtcgcccagagtggagtgcaggggtgcaatctcagctcactgcaagctccacctcctgggtccctgccattctcctgcctcagcctcccgagtagctgggactataggcgcccgccaccacgcctggctaattttttgtagttttagtagagacaggatttcaccatgttagccatcatggtcttgaccttctgaccttgtgatccgcccgcctcagcctaccaaagtgctgggattacaggcatgagccacagcgcccggccatcaagcttctttctctctccccctctctgtttcttgcacagctgtacagactttttgtatgtagtaagcatgtttacctgtgactagtaattccagcacaaacatttcacccccttatagctctgcagatattttctggaatgactggagatggcctgtcttcagtcatgatccatccctgaaccaatcatgataaaatctctttggttggttctaccacatgcattaatttctgctagagcatgggggtcctgtgaaggaaccaaatatctatgatgcttgttaaagacagaatgaaagactttactcaagagggactatcgtgataggtgaaatggggtcttgcagtgggggagaaagattgggctcaattctgaacgcaacaaccaaaagtggtgatttatagccaggaagtcaagtgagggtcagtggatggagacagcagaggtaagggaggattctgagtaaatgaactaacaaggttcttgctaacactggacaatgcagaggcagcacagaagctcaagcgtcaggcctcacggggaaaaggattcagatgagtctgaaatatgctgagtttggtggcttacgtctgtaatttcagtgactcagaaggctgaggtggtaggactgcttgaggccaggactttgagaccagcctaggcaacatagcaagacaccatctctaaaaaagataattaaaaaaaataaaagaagggtctgattggagtctggttaaggagaaaatctttgtcagtgcccaccctgaatatctggaacacgaacctccagaacagagagggggttctttcactagagaagctggatggtcaataataaagaatatccctgcttctggtgctcccatttatcacatgcagggaatgaaatttgcagaagtgacatgacttgaacaacgtcagacacgaagcatggaggtgaaattaaccaaaaggttgaagttaaaatgagtactttgcaatgccattaccgatgcataaactttgatgagctttgagaaataagatcaccacattttcatctacttttccagggaggtggaaaataaatagagaaatactcatttattcatctgtttaacaaacatccattgatattctttatgtgctaggtgctgtgataaacactacagaaatagcagagaacaatacagagaaaaagccatgtcttatgaatcttacattcttatacaccatcagaataaaatactgctttagaaaatatactgtgtaccttataataatagaacacaatctgttgtttctgagatgtgaaaagtcaattgtaagatttacgccatagaacaaagatgtaattcttgttacacatacacacacacaaagacacacatttaatcagggcataaatcaagatttttgtgatattaatccagtgcattcaatacagagttggataatctgttgctatttcaaatgtagttcctccctccttaaaatgattaaatcaaagtcccagaaggaacttggggaacttctaatcggtctccatgtcgtggacaaaaattaactgaattaactgtaactatctcaaatcaagacacacaataataaccactgtttattctgtgcctgccagtcactgtgcagataatttattgtgcactgtctcatttaatgcttgtggcaacctaatgaggcaggtacatttgattattagtcccattttacagtagatgaaacagaggcttatcttctgtaaagaaaattgctcttaaaacacagctcttggccgggcgtggtggctcacgcctgtaatgtcagcactttgggaggctgaggagggctaatcacctgagtttgggggttcaaaaccagcctgaccaacatggagaaatcccatctctaataaaaatacaaaattagccaggtgtggtggtgcatgctctatcatcccagctactcgggaggctgaggcaggagaattgcttgaacccgggaggcggaagttgcagtgagccgagattgtgccattccactccagcctgggcaacaagagcaaaactctgtctcaaaaaaaaaaaacaacaaacgcacaaacacacgcgcacacacacacatacacacacacacaccccacctctttgggttacatatgctttttaactgtttgaccttcggtaggtcagtaggttagcgagtgcccatgcagtgtttgcctgagcttttgcatcagccttgcctgtttttttgttttttgagttagggtcttgctctgtcacccaggctggaggacagtggtgcgatcatagctcactgcagcctcgatctcctggcctcaagtgatcctcccacctctgcctcccagtcttgccttttaagagccttaggactcttaacctgggaaatctataaaattttttgttatgtataaggaagaacacaacttttcttctgtgagtactgcttcaaagacacagagtccaatgtacataggcaggtggatagacaagctcgctgtcaaacttgttacatagatgaaatgggacagatggggtcattcatctaaagggttcttggtaaaggtacaaaaagcaaaaccatgaggccaaaaacgggagcagaaacagttggcactcagtgagtaggctccaaagctctggctcaaggtgggaacatggaagccaatggtcaagtttgttgcacagtgcacttaataagatgaacagcagtgctagaatctggaggatcatcatccctggagcttgacagccaatatctagcctgcttgagagtgcagatgaagcgctcggcaaatgtagttttatttacagcttcgtaagcctagatgggtaatcctctgtggtgtcctttagagggaaacgtaaaatggggatgacgactttaaataccttccagagttagatggcttttagacaccaaagttcagcctcttgcaacatattgcatttcagcccctgccacggttctctgctgacatttcagagatgggcagacaccatggcattgcagttgacatggcagcttggccaggtaggagctcacatatggagcatttcttgctttaggtgttaaaaaacaagtcatatctttaaaaggtcaccgtggtttgtactaactatatgactattgaaaggcacagtttggggcaagcctgtttattatttttcaaattagagaagtgatattgcgtcactgctgcgaaccaggaagggagaatgagaaagaaaatcacccatgaccaccaccatccctcttggaattgtgtcgtgctctctagcctccttcctttaagatgatggtttctatggaaaattgctcttaaaacaaacctccttaagttatatatactttgcaactacatggtcttcggtaggtcaaaaagtgcccatgcacttttcccctgcgctcttgcgtcaaccttgccttcttttatttttacttatttatttatttatttattcatttatgtatttatttattttttgagtttgggtcttgctctgtcacccaggctggagtacagtggtgcagtcatagctcactgcagcctcgacctcctggcctcaagtgacctcccacctctgcctcttagagcttttgggagcttgcatgatatgacggttgtgactaatgttaggaacatccaaggagtagacattggaaggactcctctcatgccaccatgagctgttgcccccaggaaatgagtgaagtctcagtaaaatggagagaactttaattcccgggtagatgtatctgaatctgagactgaacattttgttggtaacacaccagttatcaggagtgtcttgatcatgctcatctttgtctaatctttagatttctcatctttccggggaggttaagagttgctgtgtcctttctcagtcccaccacttgaacatgtggtaacatgtatgaggaaatgctttgtacataacaaatcatgtgaaagtaaaggattgtcgtcatttttgccattgctattaatattattacacagggtttctagtatattatgttggttaagagcaagcctctagagcaagcttctccagcccatgtcccccacagggtgcatgtggcccgggacggctttgaatgttgtccaacaataattcataaattttcttacaaccttatgagacgtttttgggggatttttttttttagctcatcagctgtcattagtattaatgtattttatgtatgacctgagacacttcttcttccgccgtggctcagggaagccaaaagactggacacccctgttctagagccagtcctaactctactcatttctacctagctgtgtgaccttgggcaagttagttaacctctctgatcattggcttctcctttagatgctgctgcatttttacctctctcataagattgctgtgaggaggctgagacaaggcagggcatcgtgcttgcagcaacaccctgcacgtagcaagggtaccacaaatggtagctatcaatgttgttatttgatgatccagaatatgtattgcttttgtcatcctttccctagtctttcatcattctggattttccatgtctttaagtttgttgctgtcttagaattagtagattttcatggttctaagactctatctgaaaactgtgcatggtggatcttgttaatgtggtaaaaatgtcatctgtcacagcatcccagttcatgatttaatttatccttccacagatagcctttattatattagcttgtagtgtatatttaatgaactagtgtaaaagtcatttttctctggctgggtgcagtggcttacagttgtaatcccagcactttgggaggctgaggcaggcagatcacttgaggtcaggagttcaagactaacctgaccaacatggtgaaacctcatctctactgaaaataaagaaaattaccagccgcattacatgcctgtaatcccagctattcgggaggctgaggcaggataattgcttgaactggggaggtggaggttgtagtgagccaagattgtgccactgcactgcagcctggacaacaaagcgagactctgtctcaaaataaaaaataaaataaatagggagatagggtcttgctctgtttgccaggttggagtgtggcagtatgaatatggctcactgcagccttgacctcctggcctcaagtgatcttcctacttcagcctcctgagtagctgggaccacatgtgtgtgccaccatgcctggctatttatttttatttgttttttactttttgtagagatgaggtcttgctgtgttgtccaggctggtctcaaactcctgggctcaactgatccaccagcctcccaaaataagctaccactcctggctgtaaaagtccttttgaaatggtacaggagttcaagaccagcctggacaacacagggagaccccgtttctacaaaaaaataaataagttagccaggtgtgatggcacacacttgtgatcctagctactcagaaggctgagatgggaggatggcctgggctgagcagttgcaggctcgttggagctgtgattgtgttactgcactccagcctgggcaacaaagcaagaccctgtctcaagcaaaaaagaaaaagcctttttcttgtaatttttaaataattccttccaatacaaaataataagtgtctagtccattgagaattaatttagaatgctcatgtgtcttggattgactttcaaaaccctgattcttaaaccatttgtgattgaggcttacaaccatgtaacaatcctcctaagttctgggagtgaatttaagtctggtaatgctattaaggaaagagagaagagtatgttttctaatgtacagtggatatcttgaagggagccatgcaggcatatttccaccttggtgtgtacttgatggggagaggcaaggagagagcgtggcaggttcagggtttgccatcccaatcttcccttggcgctgatccgtggtttccttcctgatcccacagaataagcaatgttgatctcgtgtggatcatctgttatgtaaaggtggttaataccaccattttctgcttcacatgaatcagagaacctgggtatctctgaccttcagggttccagctctcacctaagttcagccagtgtgtgaatcctctattgacctactgggaccacttggtagattgaccacagctcctgttatgcaccaagcattggcctgtgtgctcttgccagcaaaacaggtgtgatcctcagggagcctcaagtctggagggggaggcaaacattgattgaagaaacttacaatgaatgcataattaagatagggatatttactgcaaaggaaaaataaaaagattctttacatcaaatgacacatagcaccaacttgggctgagttggaagtgactcgtttatgaacaggggtatatatttttaaaagatgtactcttctctgaatgaataatttattaaatatgaaaagcaagagaaatactattaaaagaatgccacatttttagggaaagtgttgttgagggttcgaaacagacttttggtaaccggccaattccacaggctggtgccacattttcagtgccctttgatgtgtgtacgtgaaaaagctgcttgttttcctgtttaatatcaatctattaattttaaagtatttgaagagaaaatcaaagacatagtctgcatttggaaacacccagaaccacaaatctaaatcctagtaccaccaatttgaagactgtttgtcatggcttgaagcctcctgagaggggaattttatttacttgacggagtcatgtgaggttgattggtctaataaaactggattttaaatgaatgtggagcatggtgtccctttgccctgggtatttaaaaatagaccaatgatttctcatagggcgtctttcagatacactttagcagactgatgaaggctgttcccgggacacatttaaatctgaaacaaaatgagagtttaacaaggtgtgttggttcaggttaaaagcgcctacccctttcagctcagccaagatcatctctcattggacaaggttcccccaagactggctgggctcgtcccctgggtgctgaaatgattagtataacattccggagttcaggtctctgttatcttgtttctctgtcggatgcctgggaatgtgaatttgcctacacattttgagacatttttacactaggatgcttctgagctgaagatgaaggtggttggttttcttcctcctcttccccttttcaatattgtagggaccaagtggtttgttgctctctgctgccccctgttgctcatgaatgggaacagctggttttccactgaaggtgattcttaaccattacaaagagcttcccgtgaggttgaacctggggttcctagcttcatgtgaggttggctgattttatttatttatttatttttgaaactgacttttaaatgaaagttgagctaaatggggaagaaggtatctagcaatagcagaagtcccaaggttaatggaatacccaaagaacaaagtgaacagccgtgtgcctctctttccattgttggtagattccagctacctgcagctacgcttggtttcttgagagtcctagtccttgtaattgagccctggagttaagtccatttgaacaaacatcctcctagtcccaatttattccaggtcctgcatgagtggctgggattttcaggaaggagggattatagtcacatggtgtgtggttaatattttgagtgtggagtcaaagcatagttttgaatatgagcttcaactgttttcaaccgtatggctctgagccttggtgtctgtgtctgtataatgaggattttggtggtacctgattcagaggttgttgtgggaaccaatgagaaatttaaacaacttatgatttgttggtcacttaccaataccagtgcttttttttttttttttttttttgagatggatccttactctgtcacccaggctggagtgtagtggtgcaatctcggctcattgcaacctctgcctcccagattcaagcgattctcctgcctcagcctcccaagtagctgggattacatgtgcctgtcaccacacctggctaattttttttttttttttttttttttttttggatttttagtagtcatggggtctcaccaggctgatcttgaactcctgacctcagagtgctgggattacaggtttgagccaccgtgcccagcctccagtgcattttaggcactatgcttttattagctttttaatcctcagtaggacagcaaagatgcttgtcttttccctttcaaatagggctaagggctaacagcccttagcagaccttctctttatccccttgaccaggtttgtatcacatgcctgtgcctaaaccaaatgctggcaatagggacggaatgataagctttgctttgattagttagaatgattcccaaggaagggacaatgttctctgagcacacagagaatgatcactcaaatagaactagggctgaggcaggaagagagaataccctgaggatatcagtttggcttgtaactagcagggcctaccttacatagctgcaagatgatgcacttggacccaatagcccagatcccacgggtgtcataggaagtgcttatcacggagcctagcccatagcacccctgctctacagactcacccaatcactgctctcaagagggtcgtgctgtaatggggaagactgatccatcagcaaatttttgtttgtgtgtttgtttgtttgtttgttttttagatggagtcttgctctgtcacccaggctggagtgcagtggcatgatctcggctcactgcaacctcctcctcccaggttcaagcgattctcctgcctcagcgtcctgagtagctgggaccagaggcatgcactaccttgcccagctaagtttttgtatttttagtggagatggggtttcaccatgatggccaagctggttttgaactcctgacctgaagtgatctgcccgcctcggcctcccaaagttctaggattacaggcgtgagctattgctcccagcccaaatgtttttatactaaggtggaacatgctttattagctgtagtcacagacatttatggagactcagaagatccctcatatttaaaacatgtgttcctagatatgctgttgaagtttatttctttcaactgcatatcattacttgctttcatgctctctttggtccatttttggttttggttttggtttttgagatagggtcttgctttcttgcccaggctggagggcagtggcacagtcacagctcactgcagcctcaacctcttgggctcagatgatcctccagcctcagcctcccaagtagcttggaccacagacgtgcgccaccacgcccagctaattttttaattatttgtagacacggggtctcactgtgttgcccaggctggactcaaactcccaggctcatgcgatcctcctaccttggcctcccaaagtgctgagattataagtgtgagccaccagacctggccccccttctttggtctcaatccctcaactccaatatagcccttttcacccaccttcccatcttctctaaccccgggggacactggcaatctttaagcagaagaattggctgcctgaaagcctgtagatttatttggaggatgggtcaagaagaagtctcccaaaggagcttgggggaattctccttttgattttgttattcaaaaatgatgtcaaattttagaaaatgagagaaaatttagtagagtataacggttaaagagtctcaactttgctactcaacactttttgaccctgagcaacttgcacttaggggcctgagcttttcaatctgtaaatacggccaataataatacctccctcttagggcactctgagcagtcattgagagagcacgtgtaaagtgtttttgcacagtgcccagaaatttgcagtatttaatggtccttcctccttatttatttttattacttgtttttgtttttttgagacagtgtcttgctctgtcgcccaggctggagagcagtgatattatcgtgactcacggcagcctcgacctcccagactcaggtgatcccttcacctcagcctcccaggcagctgggaccatagctatgaacaaacacgtccagctatgttttgtattttttgtgaagacggagtctcaccatgttgcccaggctgatctccaactcccaggctgaagcaattcctcagcctctgcctcccaaaatgttgagattgcagacaaaaaccactgcacctggccccttcctcattctttttgaagtattttagctttcaaaaggtcaaggaccctttataacggtttgctagtttagaaagaaaaaaaaacagtgacatggtgaaaaagtaagcctgctctctctctcgttttctatgatgctctatcgggattccttggttaggagataaggtcaggcattctagggtattcagagggcccacctcttcatggggaagcccaggcttgcttgttcttatgttttgcaggacaaacgtcttagaactccacagatggggagtctgagaccctgagtgattaagtaattttgaccttgagctatctatttgacttgaagtggctaatggccagataagtgctctgagatgatatctcagtttctgctatttttcttgtgaggaaaaggaaaaaaagagcttgatagtgatcagagttcatttgcagaagtggtttccttttccccaatcaacttgtgagaattcacttctgtcctcagcgtgcgtgcttcattcattcactcatccaaagctgtctcaggcagagtgctggggactgggtgagggcggggagtctttccttcaggggcttatttctgctactgtgcatgttcttcctccacaacttgcagatccagacctctcctcctggcaagactttctcatttctttcacgtgacttttggttagaaacattggcctgactttgaggcttacacccagctttctttgtttgtgttttgttttgtttttgagacgcggtttcgctcttgttgcccaggctgaagtgcagtggtacgatcttggctcactgcaacctctgcctagcgggttcaagcgattctcctgcctcagcctcccgagtagctgggagtacaggtatgcgccgctatgcccagctaattttgtatttttatagagagggggtttcaccatgttgatctggctggtctcgaactcccgacttcaggtgatctgcccgcctcggcctcccggtgttgggattacaggcgtgagccactgtgcccgaccctcacacccaggtttttaggatacccttggttctatgcccctgatgacctgaaggcaggcaggagaagtagcagtgtgtgtttgtgtgtgtgtgtgtgtgtctgtgtgtgtgcatgcgcgcacgcacatgcacgtaaggggatgatgcagcccgtggcgcttaaattctaccctccccaagagttgggtcccttcaccaaacattaattttttccgaactccatcttatctctgtaaaatagaagtgctgattctttttttttgtttaagttctgggatacatgtgccaaacatgcaggtttgttacataggtaaacgtgtgctgtggtggtttgctgcacctattaacccgtcacctaggcattaagccccacatgcattagccatttatcctgatgctctctcttcccccagccccctacagaccccactgtgtgatgttcccctccctgtgtccatgtcttctcattgttcagctactacttatgagtgagaacatgtggtgtttggttttctgttcctgtattagttttctgaggacggtggctcccagcttcatccatgtccttgcaaaggacgtgatttcattcctttttatggctgcatagtattccatggtgtataggtaccacttacctagtaatagacaagcacatgcattgggtttgaattttgcaagtgagttgttggaagggaacccctagatgtcatttgcatgctaagtgctttccccgactgtgttatttgctgttcacccagccccgtgcattccatctctcacatttttcatgcgagtgttctgctgcccaaagttactctgtatagtgtttaatccactctgagtcagttctgcagagcagtcggtggtaaagtcctttcaccagcactgtctgagagttcctgtgacaacagcatccccgttcattgaggcctgagtgttcttttagattcctgcttaaacataaaccagcagtgaacgaagaatctttagtacctgacgtgaaatggagcccaagtctatactgctgactgggctgggggcgcatgcttggttggggttcattatatctgaactcatatcagggagatgatttactgtttctcaataaaagatggagttttgaagaataccttcttttgtgtgggatggaaacatgtggctaagcctattgcatcaccttgtacaaaagagatattcagcaggtatttattaagctaaactgaatcatgctcaaagacgctcctcttccctaagcaccattcagttgaatgtaacatgaaagagacaatgcatcatgttcattctggtttagggtctttccttgttgaaggctttctgctgtttagagaaagaccaagtatagcagccagaaaaacacagagctggcaactgagtcacaaagctgtagcaacacatcactcaagaggaacccttctcacaatgggtagatatacattgagtggtgatgtggagtgagacggattgatatccacaatgtcccaaaaggaaaagagacaaatttgacagtaatccaatttccgtcagcaaatttagatgatgagatgaaaagttagatttatgaggatagattcattctcactaggtattatgacgttagaacgcctgccaggtgaaaagtggcacatttttaggggaatttaggtccaacgaaaaggtgtttccttaggcagaaattgaaacatgatctgtctgtccagagttttgtgccttcgagcacacatgtgcatgcaagcttttaattaaccaagaagttcttctttaacgtttatatatatatatatgtatatgtatctacagaaataggataaaaagaagttcagaattcaactgtgattccaatatccatagataactattgctaacactttctagccttttttctctatgtgtatacacatatttggaaatttggaatcactgtaacctgctttgtcttaagatagcatgagaatttcttcatgctataaatgtccttccgaagtgtaatactttaaataactatatactgttccattgtatggatgcagcataggaaactcattccccttggctggatatttatcttactttttttttttttttgagatggagtcttgctctttcaccaggctgggtgccgtggcgtgatctcggctcactgcaccctgtgtctcctgggttcaagcaattctcctgcctcagcctcccaagaagctggggctataggcgagcaccaccacacccagttaatttttgtacttttagtagagatggggtttccccatggtggccagaatggtctcgatctcttgaccttgtgatccacctgcctcggcctcccaaaatgctgggattacaggcgtcagccaccacacccagccttatcttatttcttgtataaaaactcctgcgtgtgtgtgtttgtgtgtgtgtgtaaaacttttattctaatcaagcatattttcacaatttctacagcagccacaacaaactttctacaaggtgaattttagagagaagaggttcaccgtctcgttatttcaacctcatcatctgtaacggtggccatagaacctattctgatttactctaccagaaaacttaccctcttagttactttttttctttcattttttttttctcagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgatttagtaattgtcatttgtctattattaggtgaaattttctagctgaatttttccaaagatgaataaacaaattaatcattcactttcctatccaccattcaaccatccatgcatcctccctcccttccttcctcccccttccctttccttttctccttccttccttccttctgcatttattaaataccaactctgtgttaggcagtatgttgcatgccaaagacaaatgtataaactagatagaatggtggaatgctttccttctgagcactcacattttaatgctgggaattttatgctgaggttcagtgcttttcagggagccatgaaccccctgcaatgacttgcagactgtaggtattacatgtaaaacttgtgtgagtaatttcctgaagaaggggtttcattcttcagatcctcaaaaagatctatgatccggccaggcgcggtggctcatgcctgtaatcccagcactttgggagaccaaggcgggcatatcaggaggtcaggagatcaataccatcctcgctaacacagtgaaatcccatctctactaaaaatacaaaaaattagctgggtgtggtggcgcatgcctgtaatcccagctactcgagaggccgaggcaggacaacagcttgaacccaggaggcggaggttgcagtgagccaacagagtgaaactctgtctcaaaaaaaaaaaaaatatatatatatatatatgatcctaaaaagacattgatattaaagagtaatgatggggaaggaccaccaagtgatcatttataagatgctgcgagaattgctaaagttgagggatggattctgcattccaggagaacaaaggaggtagatcccgattaactgagtagcaggatattgagggaagcttcttgtaatgattcagctgagtcttacacaatgaatgagacttggatagatgaacatgcattaggagacatcagttctggtcagaggaaacagcaaatgcaaaggcccagagccataagagattcagatgcactaaagaaatatcccatcatttaggatggtcggcatatacacagagggcctataaggaaggagaagaaactgaggttgtagaagctggtagggactgcatgctgaaaggcattgtaaatcttagactaaaatctgtgggagactttgaacaacctaaagattttaagcagagtgatgcaatgcatttgtcttttgaatgcaaatattgctggggcgggtcttttgtgttatcagctaatgatttagttggtggttacctgagtacggggtcaggtgtatgttcttagctggtggaggccttggggatgtagaagcacaaacgggtaagtcactggaaaggtaggtgaaagattggccaatattagaggtgggtgtttatagaaatgaatgacaatgaccactgagtagttcctaagacaccatcgctttgcataaatcatgtcattgaatcctcttaagaacacacaaactcaaatattgtgtattagtttcccatggctgctgtaataaatgatcacattcttagtggcttgaaagaatatggatttagtatcttacagttctggaggtcagaagtcctaagtgggtctaactgggctaacatcacgaggtaggcagcaataagaaactaatcttttggtggctttgggtacagtccctttccttgccttttatagccactagaggcctcctgcatgccttggctcgtggccccttcttccatcttcaaagccagcattggtgagttgagtcctttttcacatcatgtcactccattcttctgcctccctcttctaggttttaaggagacttgtgactacattgggcccacagagataatccagaatagtctccctattttgaggtcagatgattagtaactttaattccacctattcccttaattccctgttgccctgtaaggtaaaatatattcacaggttccaggtatcatgacatgcacatctttaagaggctgctattctgcagatcacatatcatcatctccactcttctgagtgtagcagcaagcagtcttttaggttaatgtgctacagctatagaaagttgaaaccaagatatgaaccatgatgcttttggctccaaagtcagcaggttctaaaaggtaaaccttggtccccaattaatgatcaaaggcagtgggaaaaatctaacattctgatgactttgtagatcaatgagttttgtttcacaagtctaatgcattacgttaccatattgatctttactcttcagattctgaacacacctgtgaaagcagggtttactgttcttttgacaacctgccatctctaattagctccagggccccttagtgcagtaaacaaatccgctgaatgactcagtcctctttctcttttcttattgttggatccgttaagctgtacaaatgtagtctatggtggagggaggggtgagagcagaggggaagagaaggggtgcacagttggtcactacattatcctgcttctgctccaagaataaaagcaaaacttaaaaaaagtattgattcatatggtttgttcatatgtatgggaagcatgtgatattttggtacatcccatgcatgtgcaatggtcaagttagggtatttaagatattcatcgctttgaacattgatcaattctttctgttggcaacttttcaaatcttcttttctagctattcttaaatatataatacattactgttaactattgtcaccttactgtgctgtggaacattaaaactcacttctcctatctaactgtaggtttgcacccattaaccgatttgtcttcatttcccactccacccccacacccttcccagccttagtcaccataaccctattctcttacatctatgatacccacttatgaactcctttctcctggtccatgaagtctttaaaagctatttcgtcagaagaagatttgtctgacccccttccctatgtaaatgcagcacattgtcatactctctcaacacactcttatttctctttatagaggtcaccagatttttaactcctttacaggattttctacttttttatagggtgagcggtctatatctattttattgtcactttatcctttcactcctcaactgactacatggtaggtattcaaaaaaaacatttgttgaggccgagtgtcatggctcacgcctgtaatcccaggacttttgaaggctgaggcaggcggatcacctgaggtcatgagttcgagaccagcctggccaacatggggaaaccccatctttactaaaaatataaaaattagccaggtgtggtgtcaggagcctggaatcccagctacctgggagaccgaggctgggagaattgcttgaacctgggagttggaggttgcagagagccaagattgcgccactgcactccaccctgtatgacacagtgagactctgtctcaaaaaaacaaaacaaaacaaaacaaattgttgaataaatggtcctctagtgttttaatggcttttacttttgcttctgctactggtccttattcatccatctacctccccatctatctgtccatctacccatgcatctatgtgtctgtccattcatccactcattcctccatctatctacctacctgttcacacatccacctatccatccgtcctccttgaagacatacttaagagtacctagcaatccttctggagttccacattctcctctctattttcttcagcctgaagtcccaactggtacatgggcttggtgtgagggaactaataaatgcttatcatgagaataataaaagctaagatttatttattgagtgctagtcacatggcagccaagctctaaatgcttcacatgcattaagttagtaagtgtaggaagccctctgcagtaggcatttgtaatatccccaccctgaggatggtgaaactgagagacagcaaccatgggaacacagggagtaaggctgggatgaatccctggcaagcgaactgttaattctatgtctcctaccttcttgttttccctagcctgctgcaagtccagcttaaaggaaggaaagttctaataaattgaaaatgttaactctgtggactagacatcttcacgtgcttcgtgttcaacatgttataacttcaccataatacaaattaccatcatgagtttatttttgtatatggtgtaaggaagaggtccagttacagtcttctgcatatggctagtcagttatcccagtaccatttattgaatagggaatcctttccccattgcttatttttgtcaactttgtcgaagatcagatggttattggtgtgtggcattatttctgggccctctgttctgttccattggtctttgtgtctgtttttgtatcagtagtgccatgctgttttggttactgtagccttgtagtatagtttgaagttgggtaacttgatggttagaatgttctatttgcttaggattgccttgactattcaggctcttttttggttctatatgaatttaaaaatagtgttttttaattcctatggtgggaagaaagtgtggataaaaaactgcctatcagatgctatgtttatcacctgggtgacagaataatctatacaccaaaaccatgtgagatgcaatttacctgtatgacaaacctgcacatgtaccactgaccctaaaataaaagtttaaaaatattacccttttgtttgcttcattttgcaagaaaactggttggctatccccaaaaagatgcaattactgtcatcttcactgagtggtctgtaggtaaacaagcatctggagatgagtttaagtcctcatggtttaggattttaatatatactaattaaaacgagcaacatgttattattcaataaagaatagaagcaattgattttaaatcatagccaggtgcagtggctcgcacctgtaggcacatctacttggaaggttgaggtgggaagatctgttgagaccaagaattcaaggtcagcctaggtatagtgagacgccatctcttaaaaaattaataataataaaatcatagtatataatcatgcttagagtaaagatctggaaggatactcaatatactaggatttccaggttagaggggcaatgggggttaaggatagtgatcacatgcaactttaatcttgtctacaatttttctaacaaaaggtatttatgtattgtgtaattaagggcatgggacggtctgtgaattctgtaatcttttccttttcttttcttgcagcacagtctcactctgtcacccaggctagagtgcagtggctcaagtgtagctccctgcagccttaacctcctaggctcaagcgatcctttctcctcagcctcctaaatagctgggaccacaggtgcattccagcatgccccactcatttttttttttgtaaagatgggggtctcactgtgttgcccaggctgatctcaaactcctaggctcaagcaattctccctcctccgcctcccaaagttctgagattacagactggagcccctgtgccctgcctgtatattgtttgagaagtcatattcttcctcttctgcccgcccctgctggctttcgcaaaagagaaatcatgccgcttttttaggtaatctgtgttctgtggagggtttctaatttacttttaaagttagtggtcctcgacatgacttgtcccagttttgccattgaaaagaccccaaatgtgcatgagaaacctactgtgaaatagatttccagttttgacctgagctttgtcccaaggactcatctgtgtcagaggaggagatcctcccaaaatgtgctttccatggatgaggaagaccagccatttccctttgacggcctccttgcattttatcattccctgagccaccgttccaaaggaagagagaccattggggaaatgattttgagaagaggtctatcaactattccatttcttttgaaccccaggtggcacttctcagcaacaaggaggcatttaggcaaagagggaacagtttctatgtaaaacctaaaacgcttggactcacagagaaaggcagaattaatcactctctaaagtcaccaagagagaaactgacatgctcactagacattagaataccaacagtagcaagcattccactggaagcttgaaaggagttattttaggagaaataaaagaaagggctagttttgaagcaggtaggtcatagataagagctctggaattcagctccttctagtttttattccaagttctccagtgctgggagtttaagatcacaggcattgcatcttatcctatgactcagtttcctcatctgcacattggaaataatgacagtatcaacctcatagtgttgttgtgaggattaaattaaattatacctataggaggggctggccatggtggctcacgcctgtaatcccaacaccttgggaggctgaggcggatcacctgaggtcataagtttgagaccagcctggccaacatgatgaaaccctgtctctactaaaaatgcaaaagttactaagggatggtggtgcatgcctgtagtcccagctactcgagaggctgaggcaggagaatcgctggaacccgggaggcaaagtttgcagtgacttgagatggcaccactgcactccagcctgggcaacagagtgatactccatctcaagaaaaacaaaacaaataaaatgaaacacacatgaaacccagtggattccttagcacctaataagtatgggcccatacatatatcatcatcctcagcattactggaggttattaacagaaattggtgttaataaagtttaaataaacaggtggatttggaattcctttccaagtaaaacatttaaagtaactttgagggtgaatatacaaataagtgaagtcaagatgctaaatccttcatgggtttgtaagtgaccaggggatatttaggacatctcccttatttctaagagtaggagctcatgaaactccaacacctcactctttttacggcctgtgtctgtgcactttctgtggagctgattggacccttgggggatggccttgcaggtcagacagtcccagcatcttcttttcactctttctctttcagtttctgggttttcacagccaagggaaaggtaggcagaactggaagcaagtggaaatgctcggtctgccattcatctaggaaggcagacgcctctaacaagtttgaacctgataaagcctctgcctgtgcaaagaacttgggaagcagccagcaccgtgcttttttacctctgattagttcttcttccattctctcttctgcgatggaaagaaaaagaaaaaaaaaaaaagacatggagttgagacagcagagaaagtccaaaactgggtaattcagaggggcaggctaatgacccacctgagtctgggatcgttaccaacagtgcctggttttcactgtgacaaatatgaaggtaggcccacagttagtgagagagttgccttgtctatctcctggcgtgccttcccacaggctcccagtggagtctggtcatcagtcttctccctttggagcttgggcccagatctcagccacccaggccacgatggggaagagcctggcctgccccaaaggtggccctttcagagtttaagacgatggagatacaatggaagtctcatcatgtgtcactttgcctttgactccgtgttgccatggaaacagaacatggcttgttcatggtaaacgaccttgtcattgatttttgtatatgctcttaattattgtggcatagttatttataacctgatggggaaggaaatcccaggagaagagcattgtcctgctgaattattccatagtgggaaggagaaaagttctgtcccaaagaaaagaggagaaaaggaaaggaaacgaagatgaaattttcaaatataaataagtccttcaggaaaatcgttccccagatgcattattgcattatttaggaccatgtgcaccccactatgtttgctctcgacatttattttggggggttttgtgtagccgtgacagcatttcctcacatctctttaggactgctgatgccctgcatatcccctgtagaactttgcggatagttcatattttagcaatgattttggaattcctggctgaaataagaggctttgtgaattctctactcctatgatggcctttgaggaaattctggatctttggtttggaagttttgggattctgtgaaccaacactttcttttcattgggtttgatacagtggcatcaatcttacagtttatcatgtaccgatgtttaaaactctaaccattggttatctggttaccatcattgtcactacgaaataaaggattagagctataaaaatactaaaatagataatacccttgattatctaccctgtgtcaaatacatgaacccaactgctcaaactgtcattcattggccaggtcatcagcctccgctgggaaggagttggcactgccaagtcccagacccttcctcagacctactgaaccacctgttgcattttaatgacggctcacccctctgcactcctggtatggtttggctgtgtcccacccaaatcttatcttgaattgtagctcccataattcccatgtgttgtgtgagggacttcgtgggagataactgaatcatgggggtggtttcccccatactgttgtcatggtggtgagtaagtcttactagatctgatggtttgataaggggaaatcgctttcacttcgttcttatattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgactcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcctggagttctacacactttgcaaactttacctcattaatcttccccaccctgggagggcctgtgtgacaggcactggtacctttatttcacagatggagaggcagcagtgccaaggggctgtgacaggcccaaggtcacctggcaagtcccttgcatggacccagaatagaaacgccaccgcctgccacaaacccctctcctctggctcctgtgaacctttgagcccccaagcctgttaagcctcttcctgtcctctctatcaatgcccacttgcactgcctcctaaattagctttgtgtctttaaccccagcctcgggaggcccaggttcaaggttagcactaagcaccttttgagttccttgtaagttggacgctggaataattctaagtcaagagcaattaattatagaagcattagtcctgcagaaaccctgcttcagtcttttgtttctggctgctgccaagggccatgcacattctctgtattatctttctctgcatgccttcagagtttatacattcatttccaccaaaaagctcatcatctgagacccttactacgggtacagatgtccagacaccacatccagctaaaaatccagaatcaatcactgttttactaacaagttcctcaggggactctgagacacacccatcccggaaaattcctaagtggagccaggtgcatcagtttccaggagcactaagtgtccaaccctgattggctggtaaataattgggagggatgtggcttgggttgagggatgtggcttcgttgaaggacggcctggactgcacttcgtaagccaccttctgtagttctgatactattaattcatgattcatatcaacagaggatgggctgggtagtcgagttcctggttctttattaggcagagaatgtttctccatctggttgagagtctgtcatgttgtatgagtccagggggcgacacattttagaatttgaaaataggtcgaacccgatttgctttctttattaggcagcactcacctgggggaatggataactccatttggttcagtcaaaatgaaaattggccaaagaaagtgttaagagggcctgccatttgtgtgagttgagccataaacattggcctgctttttagcttgtggttcattggtgtatagatgatttcatgatgacgtcagtaaagggtctatgagaacacaaactacaccgaaattgacatctgatagggtcctgttgtctatgtagccacaggaggttagttctgagtgtcttcatggttaaagaagaattcagtcaattgattatgtgattctatttttataaaatatccagaggaattaaatccatagaggcagaatgctgattgctgattgccagggtctgaggggatggggaagtgagagcaattgcctaatggttgtggggttttcttttggtgtgatgaaaatattttggaacttgatagaggtagtggctgtacaacaagctgtcactgaagtattcactttagcatagtacattttgtgactgtcacttcacaaacagagtcacaaacaaaattcatgactgtccttgattttgagaggagactgtatacaggaaagtgctctgtgacttttacgaaataagacaaataaaataaaccctaacccaactccgggcatccttcccttttctcaaagacctcaccctaatttaagagaacatgaataacaaatattttacttccatattaaaggagttcttttctctgtatgtcatttatcatagcaaacaataaaatgggtatgaatcatcatctttacaagaaggtggtgtaacagcctcattctgaatccaggagccatctctagataaaacaagatgcatggaagatgtgacttaggaatgttgagcacatattattctttttataaaatagcagagttgaatgttggggatgctctaaagtagtcaacttcagcttaattgaaatgtgatgcaggcttattgcattattgttttttttgttgttgtttttttttgttgttgttgttttttgagacggagtcttgctctgtcacccaggctggagtgcagtggcccgatctcggctcactgcaagctccgccttctgggttcacgccattctcctgcctcagcctcccgaggagctgggactacaggcgcccgccattacgcctggctaatgttttgtatttttagtagagacggggtttcaccatgttagccaggatggtctcgatttcctgaccgcgtgatccgcccgccgcggcctcccaaagtgctgggattacaggcatgagccaccgcgcccggccggcttattgctttattctaatgtgatgctttggtagacctgagcttcctccacacactaaacacaaaccttgcacttaatagactttgattgaaggtgcattcaaagttcaagatgatcagtttggattctctttttttgtcacataataacgaatatttattgagttgctatagtagggtccatactttccatacattgatctatctaacattacagcaacaccttaatatagagactattattgtttctgtgttttaaaagaagaatcccggtccatcaatcttaattaacttgcccaggttaacagtgtttgtcaaaatagcaaagttgggatttgaaccctgggtggcctgaacaccaaagcctgtactgttaccatcaccctcttataggaatgttccttaagtgttcttatgtgtaagaagagtctgagatgaagagtttcagagggatgactgtgtggccaatcttccctacaggcacaaagggatttttttccgtctcgaaattgtcagcctcctattctaaaggtacaggttcctcctatagagttttagggtcagatgtcagttttaccccaagtccaccactagctagcagtttgacctttgccaagctccaaaaaccatctgtgtccattttcttcctctgtaaaatgggtataatactgacttctgagaaaggctgttacaagctttcaaagaaatggtatttatgagaacatctaaaggctggagtctccggacccactctctcactttccccttctctgtcctcaaaacagcatgcaccttcagtgggtgtaggcctctgggtctccatcctttccccaccaaataatcacatgcagacagttgtaaaaaccacagagcattttcctgtacacgatgtcctcatactgaaccaagtcgttagcatccatgtgtggctttattttttctcacaaggcagcctggaaagaacaaatttatttgggtgtgatggttttgtatcttctactttttaaattattattattattttattatttttatttttttgagacagagtttcgctcttgttgcctaggctggagtgcaatgatgtgatcttggcacactgcaacctccacctcccaggttcaagtgatactcctgcctcaccctccggagtagctgggattacaggcactggccaccaggcccagcgtggctcatacctgtaatcccagcaatttgggaagctgaggtgggtggatcacctgaggtcaggaatttgagaccagcctggccaacgtggtgaaacctgtctgtactaaaaatataaattatttttattgtcctggaacactcctacccctgcccaaatcctgcacatatccacagctgcccttgccctcatctgccggggcagctgtagtgggaatctgtggggccagattgtccgttcctgggaggtgattatttggccagtccacgaatagtgcactgcagtaggcctggctctcggaggcccagggtgggagctgattgctttggcttgatcacatttcttgagagtttcacattctaataattaaaacccaaaatggtgtgactgttgcattggctgcattttgtttcctatgtgtgtagcagggtggtctgatttccttccttataattcaagtattctgaacagcagtatgagtttcggcctgaaggaatttattagggtaatcttccctctttcagccaaaaaaaaaaaaaaaaaatgcacccagaaatgcatttagtggaaacctctagtgacaagcaatattctttcttcctttctcctttcttccctctcactatctttccttcttagaaagaatgttgtgacatcattaggtctgtagtaagagtttgttaatttttctaagaaattatctttaacactgtataaacccagtttttatttcatatgatcagatttaagttggtgcttcagtctctaagtcttacaacggtgtcatttgcaacaacatcaatcattgaattgcacgtcaacggctgaggacatctttctctgcacaggaaaagtttcctttcaggcaggttgatctggatgttagtttcaggataattctctctctctctccaccctcccaccccttccagcagctcacgccacgtcttccctctccctctccttttatctacctctcatttttatgtaaagcattgtctttcagataatattgttcccttgtgaattttatagaacggttattgaatcattttcgcctcgatttccaagtgtgttacctttaccttgacttggtgaatcacagctgttaaactgtgtctcgtgattttcattttagagtaggtcctggtttttattatagaatatgctcatcttttctaagccttgtgtcctggcttgtaggacagggttggggttggaagtaacttggggtcatttggggttttttttagaagaaagtgatggagtctgggaatttctctgcaggcttcttagagtgttcagggccattctaatgctttcccttggttcagtcttgcaagactttcataattgtgagcaaccacagtgtcttcccctcttttggacaattaagggatttaaaatatagatcgaagttggacacttgttggtgatttaggagatgaacagtagcactgtgtgtcagatatctgagaacatgcaatatttgctcagtgggtagtgggataagccagttccatccaagtcatgcagcctaagaatgaagaggaggcttggggtctgaaccctgtgggtttaattctgtctctgacagttaccagttttgtgactgtgagctattactttcattctgcagtactcatatgacaaaagatgggagaagtgataatggtattcccttcataagtatttttgtgaaagttaaattagatgacatatgtaagatatctaacatatgtctgatgtatcacggtcacacaataatattataacttattaaatttattattactgttgttgtcagtcaggctaggttgatgctgtaacaaacatcccccaacttttcaggtacttaacagcatcaaagttgatgccttattcatacaaagccatgaacaagttttctagatcaagtgataacaagcagattcaggctccttccatcttgtgactctgctgtttcctggcttcagtcacccttgaatcatccaaccaagagacagaagcaagagccactgagctaaggatctgggggtgggaaatgtggaggtcaagtctggagtggacattcctcacttccacctgcatgccattggccagaaccagtcatgtgacctccatttcaccacagagtagcatgggaaagagtctccctggggccctagaaagatgaaacaggattggtgaggtccacccgccacagggttactttttggtacctgaaattccccttttttgctctgttccaatttggaagaaacttttcttttgactctgggctattacttcgccctagccattggggctcagcctctgtggtctcagcttattgtcctcttcctctgttcccagttcttgccttgaccctagagaatttcaacactctggtcctcagcctagcaggattgtccactctatcctgaatagcaacagtcatagccttctaattagggacatcataggtttctcccagttgaaacacacacacacacacacacacacacaatattatttttaattgacagacaataattgtatatgtttgtaggatacaatgtgatgttttgctatctgtatgcaatgggcagtgattaatggttccatttaaaatacgcttcttaagtataaggagaatatccttcatcagtactctttatattgcaatattaagggaaacctttagaacttaaagaataaataccttcttccaagagtcaagtgacactatcttggaaataaggtaatattcaaagtaggtttttaaaatggttttatagaggtataatttatataacataaaatccacctttttcaattttacaattcaattatctttagaaaatttacagtctaattttagaacactgtcctctccttaaagagagctcgcctccaagcccatcttgcagtcaatctctgttcccaccctcagccccaggcaaccactaatctatcgtgttcctagcagcataattcaaaatagcccagaagtgtaagcagtcaaaatgtccatcaactggtgagtcaacaaaacttgctatattcaaatactgtaatacactttagccaaaacaaacaaagagataaaacaaaaaaacagaatacaaatagaagctacaccacatagatgaacctcggaaaacattatgcacatattatgcaaagtgaaggaagtgagctgcaaaagactacttattatgagattcctgtttatgaaatgtccagaaaaggcaaacctaacgttgattttgattgcaattttccattaggcaaatacctagaactttcttttctaggagcctgaactactcacatgccttgggcctttggggctaattctctttaacataagaatggctaatttgttgcttcttagatttgctttgtcattttgtctaccaagggaagaaattcagaagccaagaaggagatggtgactttgccagagccatattaaaaaggaaaccatcttacagctcatcattcctctctcacctgaatcttgtttgatttctcaaagcccatgtgggaccaccctccatttttaagttactgttttggagaatatgtacagtgtctactggcacctggtggcaggcaggaatgtttaagctgatcatttgttttaaacgtaatccatttgtaacgcatgattcatctattgctagaaggtacttggcatcctttgcatataccgtgactcaaactgtgacaatgtttatagctcagaaggtaaaaaaaaaaatcagagttttgttcatcagaattatcacaaattccacatttttggaattgaagataatgccatcttagcctatttaagactggcattctagaaagaggcatgctgatgcaagcaaagcaaagacaatcccaaaaattaacctgttttagaaatgagcagccaaatgtctcctaaacttctatggttattttcatggacactaccttttattttattttatttttttgtttttctgcttataaaatactatgtactaattgagaaaaacttggaaagtagaaaaaaaatatatatatatatataaattaattcccttgtcattcctgtgtctagaatagttaataacatcattctgatggatttaccttttatttatgttttcctgtatgtatgtgagaactcaggcacttaattgggcttaagctgtatatgttccataccctgctattgttgcttgacattttattatggatattttcctccatgtcattaaatattcttcaaaaagataaacttaatggtcatagtaacccaacatttttggatacaccatcccacttgccaccccccagctctttacactaatattgctttagtcttttttttttccatcctagttaaaagctgagatgaaaatttgtaagtagagatggctgagcacttctccattttccttcaatggctcttaaaagtaaaataattggctccaggtatagacaatattaaggattgaaattgtctgtattgacttctttatcaagaatcaggtagttttggccgggcccagtagctcctgcctgtaattccagcactttgggaggtctaggcaggctgaatcacctgaggtcaggcattccagactaccctggccaacatggcaaaaccccatctctagtaaaaatacaaaaaaaattagtcaggcttgatgacaggtgtctgtaatatcagctactccactagggaggctgaggcaggagaattgcttgacccctggagtgggaggttgtagtaagccaagatcgtgccactgtactccagcctgggcaaaaagagtgagtatctgtctcaaaaataaaaaaaaaaaaaggtagttccatgctcttataaataaagaatagtactgcgttagcacataaaaatgggttgaccttcaatgagacggtcatggactttcgttcagaaagactttaggaaagtctcttcattgccaaggggtatggtccatctcttatggaagtatgcatatcataaggaattaaaatgactctccttcttttcctttttttgagacggagtgtcgctctgttgcccagggtggagtgcagtggcctgatctcagctcactgcaagctctgcctcccgggttcatgccatccttctgcctcagcctcccaagtagctgggaccacagatgcccatcaccatgcctggctaatttttttttcggatttctagtagagacggggtttcactgtgttagccaggatggtctcaatctcctgacctcgtgatctgccctccttggcctcccaaagggctgggattacaggcgtgagccaccatgcctggccacccctccttcttttaaaaaattcctgcagtcactctgaagaatgccatttagaacattcgagtgaaccaaacataatcagcagcccagagaagacctcttttacctgcctcctcttatgttgctgctgagatgaacacagtccttggaaagtggtggttgtgcctttgcttttttgtttttttgtttttttagttatgggccttgccattggtttcttctgggtccccatctgtggcctctttgcttatcatggcctggtgaccccctagtacctgatgatatctatagtaggtctgctaggaaaggcttggagtcttcctttcactacccatgaaatgaccctccaggcaagtcactttcctaacacagcattaataggtgttgcttctttgagataacctctttcttatccacatgctcagggtacatatctttgtgtttttgtttagtaagacacactcctctgaagctaaacttaatctgcggagatgtcggatgataaatttgtcccctactgtagtgtcataatatatcctctatgtattaattaaaatgaagttagatattgcttttcagacaacattagttcaagatgctttcagtacaggattaatacatgtatggatgcacggatggatggatacatagatgaatgggtgaatgaattggtggacggatgaaaggatgactagatgcatgggtggatggataggtgggtgggtgggtgagtggatggatggatggatttgtgggtgggtgggtgggtggatggatggatgggtgtttggatgggtgggtggatggatggatgggtggatgaatagcaatttctagatcttactgtctataccttactttgagcactgagaaggaaataattaatagttgattctattaatttatgcttccaccagtttcctggaaattgaatttcagagttttagccatgtttcctccaaaaaaatcattgcctttcttgccttatcaattaagattagtcttgaaaaaaatcccacctgtgatgtcacacacagctaccttttgctgttaattctggtgaaaatattaggctcactattaatatcaatacttaatggatcataagaatcaaatatcaaatgaagagaccaacatacatgtattacttcttaaaaaaatctttaatgactaggaatgtattttaatattggtgatacctaaatttaatgcaatatacatgtctctgttgttttttagacccaagctttttctccttgagataaagaatgatgctcagggtagtgtagcagagtggttatagaagagggccccggaatcagctttctgagttctgacagctctgtcatttggtactcgtgtgacaatggatctctgtttcctattctgtgaaatagagatactaacacttgtaaggtggttgtgatatgagggtgaaagaatgcaacatagctatgtgtttaatggagtgcctgtcacacagtaaatgctgctacagggtaggtggtgctgtgctattatgtggcattatcatcatttcctttattattaaatagcagaagttgggatggattaggaagcagacactcagaaaatatggtgagcttataaatgttctttggtgcaataaattgtcacacagttggtggcttagcacgacatttattctttcacagttctagatgacagaactctgaagtcacatagaggtgctactgggcctatctccttctcaaggtcctgggggagtgtctcctccttcctcttctagcttctggtgggtgctgcccttgactggcttgtggccacatccctgactccttccaatctatgtccccatcttcacatcaccttttcctcttctgtacacgtctgatctccctctgctctctcttatagggacgcttgtgattgtattaatatttcggacccacctagataatccagaataatcaccccatctgaagatcattaattgaatctcatctacaaagacccttttctctcacaagttaacatgtacagactacagggattaggacctgatatcttcgggtggcgattattcagcttaatacagtgggttagaaataaaacttgattttccattgtacaagaatgggggtttagtcttaatggttttatcatgccatgtacataaccactgtcagtatcagtgggggcgttttctgaatcgtggcttttgttttctgtgagctcattgccccctttcccctttaatattctagtaaagcttattttacaaagaaaaatgcctgcagtgaaaagcatttcttgatcatctttggatcaatatgtaatatttatatttcactgaatcttcatgccgtgtttcaggtttagcttctgtgtcaattttgaaatgatctgtggtaaattccatattggaaagacatgggtctcctctactgacttattttcttcttattccctgaaaagcctttcttatcaccccaggaattgtggagataaattttttcactcatgaggcataatatagttagtcgatgatatatttgttgtaaaaaactctttttccattgtagtccaaacttaaatttccctagtgttcatttgctttctctattttctagtgcacttaaaaatacatttgcagtcacgattgcctgggtaagttataaatcctagatattagaatttttatgctttagaaataataaatgagggcttaccaattaaagataaaaaattacttgactggggatagtagaatattttatcagtattattaaaatttaagggcagctgaaatgccacaggaatccttgtacaacattttggtttaaaaagttggcttaaggataagttacattcttttcttcaattttacatcaaataggatattatataaatttcttaaaacagagcagaaatcttgttgaactgaatcaaatgcagagcttttctccagttgtagccctgtggttttactttttatgtttggaaatcacttttttatgtatcttgggtctctaataattaccattattactttatcaaaataatgttaataccacacatggaataaataacctcatgtgatttattgtaaaaccaaggatttaaacaattaatatatttaatccatcagcacatctactgtctatggataagtacatctattttgtggatgatcacaacaggtttttcactctaatttttggttttctgtattttcttcttcttttttttttttttttagttcattattcttttagctctctggtaccctggcttcttctttgtaggtcattgtgacttctttgcagcatcatcacaattctctatagcttgataaataacctctctggaaattgatgattgctagagaatagcacagaattctaggtaggcactgaaaaaattataaaataaaataaaagattgccttttcagaagatgatcctattaggagaagcagaattctgtatcctgcacaaacacaattgatacctaagtagtgtgcatttttaagcagtcatttgtgaaatgatgtggacttaatggcagattaaaacaactacccgctgggctgtttcaaaaaacaaaaccctccaattaagatggatccatgagaatgtgaaatcaatctgccctaacattgagcactttctgtgtgaaggacactccacgagtggcatgaaataggaacggaggagttgaatatcatctcagtcctcaagaactgtataatccagagcagtggttctcaatgggggacagttttgccccccgccagaggacactaggccatgccttgagacctatttcactgctgcaaccagggaggcagtgctgctggcattagtgggtagaggccagagacggtgctaataattctccagtgcacagcaccagcccccaccacaaagaattacctggctcaaaatgtcaatagtgttgagattgcaaaatgctagtgtggagtaaagggaaaagcatgtgcagaaaacagtatttcaaggaagtcatgataggtaccagcatatttatgagggttcagtggaaggaagagattctcatgggttatacaggggtggaatggggaggtcagacctcatgctagacttaggaagtgtgatttgccttgaaggatgggcgagagagggagatcatgagggcatttcataaagaaaaatggcaatacaagaatgatattcataattcttaatgaaaagtacgccacatacactgacttgctggaacagacgtctcatcagtcagaacagaaatgcaatgtcaccccattgttggacatacaggtctcatatcagccttgtgacaaccactctgtctcaagactcaatcagctatcttgttagaactagttttatggtgaactgggatgggcttattttcttgaagcccttcaataagaaaattggactttcctgatacacagagtgggctgtgaaaccaccaacaccttttgagttaaggagtttccaagaaagtttgtcattctacttccacccactttgtcagtgaatttcttaaaaggatattaagtgtgtgatggaatcttataggcatgtcccattggagttacagagcaaagccccaggactatggcttttgacaaatgtgtcatcaaaataaactgggtatttctaatgtgagtcattggcggtaacaggataggagaagactgtgatgatgaaggcagtatttcaaggagtttaattctggggcaaaatgcagcatgatttggaatgagaagaaaccaaggaagacttttgaaaattgtttgggtataggtagtggggtcagaaattcagacatacattagtggtatgattactaaagaatcagtaccatctaaactctctcatcttcttttaagtgatttgacaaaaaggggtaagtgtatggattgatataaataatccatatacaatacttggctcagaggataagtggttttggacttaagaaacatatgctaaaggtgtgattattaaaggatcgctaaaacttaatctgtctcattttccatttagtgatctgataaaaaaaaagtaggtgatgttatagattgaatgaagtatttcacatgaaacacttggcccagtgtaagagtggtttggaagccaataactggtatattccagaccaattagctagctggagccaattaaccattaagttcttcattgttatgaagaaggtaatacattctgtggactttaagaacttctgctataagggttataggatgaaatgcaggtaggaattgagaacagtgtctggaatcttgtcagtgttaaataaatgaatatagtaaatggtccttcaaatgtttatccgatatgtgcattctaatagagaaatcaaagtttaccttgacatgttgagtagtagtcacttgagtaataaaggttcgttaaagaagtccgaggctgggcacggtgactcacgcctgtaatcccagcactttgggaggccaagatgggcggatcacctgaggttgggagtttaagaccagcctggccaacatggagaaaccccgtctctactaaaaatacaaaagttagctgtgcatggtggtgcatgcctgtaatcccagctacctgagaggctgaggcaggataatcgtttgaacccaggagccggaggttgcggtgagctgagatcgtgccattgcactccagcctgggcaacaagagcaaaactccgtctcaaaaaaacacctggagcaagttctgaggtgagagatggagtggaatcgttttcacatgcccagagtttgatataaagaagggacatgtctgagtgaaatacttagcgggcatttggaggattttgtatctgagagatcagagtaggattgactggtttggaaatctttgtagaggggagttggaaagtgttggaaagtaatttgctacatcagcttttaagtatctcctgtttattgtttgcatttttaacttcatttgggcctagaaatggcaaggaagcaccattgaagccaagaaaaatgtatcagacagctattgccaccatggttctgtgtaacaaaccatcctaaagcatagttcctcagataactttgcttactcctgagtctgtggataagcaggcatgtgagtgctatgtggctagtccggactggattgtagactccaagatgcaagttgagttcacatctgccctggtgtctttcatcctccttagaccagagacttctttggacattttcttctcttggtgaattacagatggacaagagggtgaggccgattgcaaaagggcattttaagcttctgctcacatcacttcctctcacctctcattggccaaagcaagttatgtggccaaatccaaggttaagcatcaacatagccaccattaggctatgatactgatgtgttttttaatactacttcagggaagtaaagagccagaagaaccacagcgacataaaaggaaatttttctgggtgatgaaaagtgcaagattttgtgtggacttgttgatggtactgtggcagccatcctgtgggcatgatgagatggccaggagcatcacagagacacagctcttgaagcaaaggcagaaattgcctgtctccgcatttgttgatattgaagccgtgaagtcatgctctctgttcctcacagtgaagggcaagactaaggacaccagaggggtatgaggagggagaaaagaagaagctgaaactggaccttgggcttcacccacatttggagttatgggagtggcagaatgcctagcatgtaacatacactctagaaatgtttgttgtcttgaattgatttgaaggcgtcagacaggccgtggtctctgtgtctttttacatctgttattccactgccaggccgttctcctttgctcccatcccagagaaacctgtatcaccaccggcataataatgacatttcattattacgatctgatactctagggctggtatccagctgttctaaatagagcaggtttctgtcaaagaggtttcacttaggactaagcatgactattcaaactactgccacctggggagaaattatttaccgttcttcctagttgtcaatctctagataggtatgttctcattattttttttctcccttcatcttctctcatattcacaaagaaaaaagttttgtgttattacagaatgatctgattttagcaatgaacttcttctcttgttggttattttacagttagattcttggatgaatattatttccatcttatgcaattaagagtgatctctcatctgatttcagtgaggaaattcttctgtcgttgaccattttacggttacagtctttgaggaattttatttccatcttatgcaattaagaataatatctcatgcggcattaaattgttggactgtctttgaaattgaagacaatgagaaaattctagcatgagcatcacctttttgtgtgtacgtagctttttggatctcattacttacagtataaaaaggcaatagttgctgcagttatatttatagttgtttattcctcatttttctaatggaacttgtcaattagaatcaatggcataaaagttttcttggagggggcgtaacttatggactactaacactgcctttagttcagtctttctgatactgtttttatgagacaaacaatgatatgcttgccttgtctgttggcaccaaacccctttgaaatgtatgttagaatgtattaaggtttaggatgactaatggctagtgatgcaggacgggcaagtccaaaagttggggcttagcctgggaggattattggcttcacctgcaaaagaattcatgtgcaagcagatggtgttagacagcagtcttctattgaatgatatggctccttgcagaggagggctaactcataggcactgagcccagagttggcaacatacgggctattcacaactatatttacactgacttagaccattttcagttacatgcaaattaagggacaagttaatgcaaactgaggggtgggttatttagaactttccaggaaaggaacagtagcttccaggttgttgtcatggaaaggggtagtaacttccaggtgattgccatggcatttgtaaactatcataacactagtgtcttctgctaacgagccgtgagggtatctgggtattgcttttatcaccatttactagttcctgccattttatttttacttcatcctgtcaggacccagaaatatgtcctgccagtctcctacctaactaggattcttgtaagaaatagttggcataatgtggagtataaactttaagttttaggatttcactgccccttagaatgtaacaagtacaaattaaagggcttgcataggattgcatgctttaaatttttccagagaaaaggcaaaaagaggtctttattattatgataattttataaaataaagtgaattgaagccatatgcagtagtgaggatgtcttaacagagtagccctttaatagatttgtgcatattggctggcccaaggggtgggctatagtgagatctgtacttgtctgcataacgtctgttttttttcccctctgtccttgcatggcagccaggtggtataagattgctgagataaattccaagtatagcatatctttactctaagctagtggtcagcaaactttttctagaaagacccaggatttttgtgttgtgggccgaacagtctttcttgcaactacttattgtttatttgtgaagtttatttaccaagctacacagtgggctaggtttgccttgtggtcataattccccaatccctggtctacattacatatgataatctccagggactcaggcctctgctctcctgagctgtggtattctcctgacccacacagatttgttaaggaataggaaagtaatactatgtgcactagtgaggtataaatatctctagtacccaaaggattataaatcactctactataaagacacatgcacatgtatatttgttgtagcactgttcacaatagcagaaacttggaaccaacccaaatgcccatcagtgatagacttgataaagaaaatgtggcacatatacaccatagaatgctatgcagccataaaaaaggatgagttcatgtctttttagggacatgggtgaagctggaaaccatcattctcagcaaactaacacaggaacagaaaaccgaacaccgtatgtcctcactcataaaggggagttgaacaatgagaacacatggacacagggaggggaacatcacacaccagggcctgtcagggggtggggggcaggggaggcatagcattagaagagatccctaatgtagatgacaggttgatgggtgcagcaaaccaccatggcatgtgtatacctttctgacaaacctgcacattctgcacatgtatcccataacttaaagtataataataatttttaaaaagctgttaatcaaagttttcttattaccaagaaggctgtaggaagatactaccatgcattgcagtggagattttcttacatgaatatgataaccacaactgctgcagccacttacccacctgcttggagatgaagccagtgcaggtgaggagaggagcagagtgaagaggaacttctgaagctaaaaatatctgctagcttgtataaatgctagagtgcccagggtttcctgttatgtgcgacagcatctttcattgccgtttaatcaagtctgagttgggcttcttgttatttgcaagtacacatacctcagctgataggggagaaaacagaactcccgtgaataagatattactaggaatttagagacatgggacagcagagaagagatgagatgaaattgggagacagagggagagagaggctggtggctgtacagtaaaggtattgagaagagataagatgaaattgggagacagagggagagagatgctggaggctctacagtaaaggtattgggataatctccgttggcagatactagaagtcctttcaagagctagagtattaaacatctagttctgaatagggtgtgtgtccaagatttaaaattcctctgcaactccaaacttcattaaagtctgatgccctcaccaaagccttcttggagtagttgtagataaataaaggctgagatgctgagttccattcttgggtaagccagacccaaatgaacgggattccctgtgaaaagggtgagagttcagggggtaaagaattaaagccacaaattactatgagtgtgtaaattcctaggaatttgtggacatgtttggaagtatgctaaacgtacaaaaaaaaatatgcatgacaattacctttaaaactcagaagacagcttcaccttcgtttccaagttcattatgcatttcaaatgatcagaactaataacaattatgttcaccatacaatattagatcacctttcatggtttgaatggttccgctccaaaattctggtgttgccgatgtgataggattaagaggtgtggccattcagatgccattaggccagaatggctcctccctcataaatgagattaagcccattgtacaaagaggcttctggtagcatttggctctcttggccttctgccttttgccgtgtgaagacacagcattcctctcctctggaggatgtagctttcactcaacaactgagcctgctggcacctaggtcttgaacttcccagcctccagaactgtgagaaatacgtttctgttctttataaattgcccattctcagttattttgttatagctgcacaaaatggagtaagacgctatctaagatgagttatctttaaaatatttggaaaaaagacatagtcaagttttctttaagattttttatgtattctacttcccctaatgatctagtttccttcccaccaccatgattaaatattttcttctaaacacagtgaaagcagtaattttgttggtgataaagcgaaatatttctagtaagaacacaagatggacatctgtaacttttgaagtagcagctgtaaataatttaaaaattttttgagataattttgcactttcataagagttgcaaaagtagtccagagaatttctgtatagtcttcacccatcttctctgagtattaacattttatatcaccataatacaataatagaaactaataagttagcattaagaccatgctgttaactgaaatatatacttcattgagtttacaagattttactccagttcttttactctttttctcttccaggatccaatccattattccacattgtttttagttgccatatcaccttatgtctcagtccactcaggctcctattatgctattacaaaataccttacattgggtagattttttaaaaagaaatttatttcttatagttatggaggatggaaagtccaaaatcaaagcaccagcagattcaatgtttggtgagtgctggtttccagaatcatagatggcatcttgttgccatgtcatcacacggtgtaagggtcaaggtagctgtcttggatggcggcagtggctgctgctgccgccgcctccgcctcctccttgttctcttcctttctctttctctttctctctctccttctctccctctctttctctgtctctcttgctctcctccctccctctctccctctctttctttctctttccctctccttccttccttccttcttccttccttcctttcttccttccttccttctttgtttctccctctttctctctctctctctgtccttccttccttccttctctctttctccctctctttctccctctctttctctctctccttccttccttccttccttccctccttcctctttctctctttccccatcttcttcactaatcctgcacatgagggctcttgtcccatgacctaatcatctcccaataccatcacattagtgattaggtttcaacatgtgaatatggggagggcactaacattcagaccattttaccttagttccctccagtctgtgaatctgtgacaattcctcaggttttttttttttttgatctttcatgactttgatacgtttgatcttgcttgccatgggatcttgggtgggtcatataatatgtccgagtgtcagtttccacataggttttacagatataatggcattacctacaccatgtttcttagatggggattatataaagaaatcattttggctcaatgaatatgagctgtttataataattattgttattaattattaatattaattttagaatttttaaggggatatttctcagctcagattatctgctgtttgaccctgagtagaatgaatttatgtgttcttggaagggatgccacaaaagtgatgtgtccttagcagatcacaatggagggtcaacgatgtctttatatcttattactagtgatattagccttgatcacttagttgagaaggcatttgccaagtttcttcatggtaagattgtttttaacctttgaacttaaaagtacactaatttattactttgatggcccaatggtgattttcaatttcctctcatgccctgtacatgtattcattggaacacttgtgtaaggaagcatttttcattctcctccatttattcagtatttatatcattattgactcaacatttattttgaaggtgagctataatctaaaactgtcattatttatttttgtggctcaaatcattccacagggtatccacaggctggtttcagactcgtgaccctaagcaatcctccctcagcctcctgaaacactaggagtagaggcacaagtctccatgtctggccccattaacctttttagagtgcacatttcagtggaatttagcacattcgtaatgttatgcaaccgctacctctatccagttctaagacatttttatcaccctagaaggagaccctgtatccagtaagcagtcactcttattccttctcctctgccccagcccttagcaatcactaatctgctttctctatgtatagattttccttttctggatattttgtgtaaacagaatcatacagtatgtggctgtttgtgtccaacttcttacatttagtatagagtttttttgaagttgagccatgtggtagcacacatcagtgcttcattcccttttatggctgaataacgttccactgtatggatagactatgtatttatccgttgattagcatttgcgttgttttcattatttccttgacgtaaatagctgctatgaatatttatggagaagtatttgtttgagtacatgttttcagttcttttgggcacatacctaggagtggaattgctggatcatgcagtagctctatgttcaacttactgaggcatcagcaagctgtttcccacagcagccaccccattttacatttccatcagcaatgttggaggattccattctctttgtaaacaaatttcctatgttgtgctttcctaagggggcactggagtgaatggcatcctctccaccatcttgcttgtcatgggatcttgggtgggtcgtataatttgtctcagtctcagtttccacatgggttttataggtacactggtaatacctaccccgtgtttgttatatgaggattatataaagaaatcatcttggctcagtgaatatattagctgcttataataattattgttattaattattaatattaattttccctttccttctcaggctcttttatgttcttgcttgtggctctgaattcagatgtctgagtaaccttttagcaactcagatctgtccctgcgtttctcctctttgtaagacgtcagttctggtgctgctaacattcactgcagcccctcactctcttttttatccaaacatttctggtgtacagaacacatgcttctggatttatggtgggggctggtgaagagaagagaggagaacgaagtctggggctgttgtgtgaaacagcttgttcttcctgcagatttatttctattatttcctagagttttcacacttgatcttacatgaatgcattttgtaattttacattctactttatgatttattcatgtgtgtcctaatattacaatcaaccatatcttgataacaaatcttcctgtccaactggcctgttgggagtgtgcacctggtgtgtcctgtatgtccaggcacagccctgccaacccatcaaaatacatgcactgcaggtttatgggaacttcagtgtgtacaagacacgcctgaagagctggtcaaaacatgagactctagactctgctttgagacacagacttaatgtgtctgtgagggcctcaggagtctgtattctttacaaggtgccccagtgggtgtgatacaagctggcctgtctacatggtgggccacctgtagtgtgctgagtgtgctgtggaccacctttggagaaacaccagggaaagtgatgatgcttgaaatccttgatcctacctgcttctcttcatctcaggccactgcccgtacccagtacccccaaattctagcctccaggaatgatccagccacattaacctttttgtttttgctgtgtctgactgtgtcactccatttgcttgtacactgtgcctgccttgtctaagggagcattcctgctcatccttctgaggctcaactcagtggggacatctgttcctctgggagcttagtgtagcatggtggttaacaggtggggagctcttaaggtcaagggtgtcagggctagtctgctttctacatttaccagctgggtgaaggtgaacaagttcattgatctctctcagactgtttcctcctctgtaaaagaaggaataactaatggtacctatctttaaaggatgactgtgggattaagtgaggcaatacctgtaaaatgcctaagacagagttagtagtcaatgactctttttgttattttattttatttttgagacagagtctcattcactgtctcacccaggctggagtgcagtggcatgatctctgctcactgcaacccctgcctccggggttcaagcaattctcctgcctcagcctcctgcgtagctgggactacaggcatgcaccaccatgtccagctaattttagtgtttttagtagagatggggtttcaccgtgttggcaaggctggtctcgaactcctggcctcagatgatccgcccaccttggtcttctaaagtgctgggattacaggcgtgagccactgtgcctggccctttttgttattttttaatgtttttattttcttttaattaacgtcctgattgtctcatctgctagtctgtgagcctcttgacagtggggaacagtcctcaataatttgtgtatttctgttatttataacagaaccttgtgtctaaaagataaacacacacacacacacacacacacacacacacacacacatttttaaaggagctttcaacctgctgggaattcttgaatgaacaaatgcactttatgaattccctaatccttttctttgctattttcaccactttctcattcgagttaatctctgaagacataataccctgccatggagcctcatccctgcatgggctatttgtcacatccaggcttatattgtgctgactaggccttccgtgtgacacccgctccccattaatgattgactgacagtgggtggccaatgtgctgagtcagcaccctggggctcactggctcttcccttattgaaggggaaaggagtaactttatcttttcagttaatgggaaaaaaaagccacgggacctttgtcatccattctgctgggttgcggaatatgatctgtgtggctatgtgtgtgtatgtgtgtgtgtgtgtgtgtgtgtgtgtgtataaaatatactctctgattaaagcaccaaagttactgccaataagcttcaggataagtagaaaagatattagtttaaaagactgaaataccaccagtagaaaaataaaacaatttttcagcaaaccataaaaaaaaaaactattggaaatatgtaaactgctgttctctggagaatattagcattttaacacacatggctatcagaagaaaatctttgcataacttagggaggtacttaggaacattgcaaaattttaggagatccctcaaaaggctacacctaaaattgccttatgatgcagcatttccattcctatgaatacacacaaaggaactgaaaatagaatcttgcacagatacttgtataccagtgtttattgtagaattatttgcaatagccaaaaggtggaaacaacccaaatgtccatccatggatgaatgaataaataagatgtggtacatatatacagtggaaaatcatttgtccattataacataataaaattctgacatgtgctataatatggatgaaccttgcaaacattatgctaagtgaaagaaaccagatataaagggacaaatactatatggttctacttctagggatactaaagtagtcaaatacttagaaactgaaagtagaatagaggttaccaggggctgaaatgtgaggaataaggagttattgtttagtgaattcagagtctcagtatgggaagatgataaaattatggaaaagggtagcagcgatggttgtataacattgtgaatgtactcaatgccactgaactattcacttaaaaatagttaaaagtaatttcagcactttgggaggctgaggtgggtggatcatttcagctcagaagtccaagaccagcctgggcaacatggcaaaatcccgtctttacaaaatatacaaaaattagcccggcatgttggcacatgcctgtaatcccagctcctcaggaggctgaggtccagggatgtcttgaccctgggaagtggaggttgcagtgagctgagaatgtaccactgcctgggcaacagagcgagactccctcaaaaaaagaatagctaaaaggtaaattttatgttaggcatattatatcacaagaaaaaaatacaaggagaaaagcatataccgcttaaaaaaatgaagtcttgcttggccacaaaggttcattcccttcatggggggctcattggtttctagctgccctcgagtgtgagacataggctggagactggtaactcgtgggctggaactcacccttctgggtgttttgtttgcaccacacagtttgtattatttgtcagcatttcactaagaggtatttggcatcaaaaactgaaactggattcccttttatgttggatggtttgtccatgctgggtccacattctcctttgctacccagctccctctaaagagagtcttcagtctccatgggcacctgggccctacagaagcttgcagttatagccccagcgtgaaagttttcactctgtctcagagctgaccctctgctattggagtcattgcctttgtattgtaggatttgattattgtaatgtaaatgagcctaagatgacccctagggattgacccctgggttatttcttcactccagactgggacctggtagctggaaagcccattgttgcctaactcaattttttcttttttttgagacagtctccctctgttgcccagactggggtgcagtggcataatctcggctcatttaaacctccacctcccaggttcaagcaatcctcccacttcagccttccgagtagtgaggattacaggcatgcaccagcatgcccggctagttgttgttgttgttttttgtttgtttgtttgtattttcagtagagacggggtttcaccatgttggccaggctggtctcaaactcctgacctcaagtgatctgcccgccttggccttccaaaatggtaggattacaggcatgagtcaccgtgcctggcgccaattcaattttttaatacatccaattattttttaaaaatagcccaaacaagcagatttttaaccatctacaaccagcctgctttccatatttcacagtgcctcaccagccttaccatttggtgaaataggtctttgtagttacaaggctccaagttgagccaacgctttggaagcctccaacccagagactccccaaggggctgctgaatgacatcacctagacaagtgatcccctcctcagagttccccatcctccacatccactgctggatgatgacttgctcacacaagcctctggatggtctcatactgtaagggacattgtgcagctccctgtgcatgtgttacctcctcttacagtcatatctttgtcaagcccccaaatccttaagttccctacaattattacaatgtttttttcttatatgaaattataaataataagtcactagatggaggaggatagagatggaggagaagaagaggtgggtctacttaagagggcctttttctcccctgttgagataggaaaagcaatagaataggtgttgggaatgctcttgtttgccagggccaggagagagcatcttgtttgtctgctttgggtacatggctaggccttccaagagtcagcctcatacacatttgctctttgatgttttacaaggggccctaaactgaggataacccttggagagttaaacaatgtgaatgccatatgcctggagtgcacttctcattggtcaaggattaaattcatgggaatcgtgtacccaaagcagatgcagcctcattgtaggttctgaatccagggtgaaaaggccttgggagctgactgcagtcagcagaaatgcgtgtctaacctggattgatggttctggttgatcaggatttgcaggaaatagagtaatgcaattaccatccttggctcgctctctgtgggatgttctcacagatcagtggcaaagggttggtaggctattttcctcccattgtattgtgagatgtacaaaccttcctactgatactgccggggagagattttctgaaggattatgaggctgctatttaaaaaagtgatttccagttaaatacctttcagtattaaaatggtaaagctataaggaatggggggatagtcttccataataattgcttctcaaggagcttagtctgattgtcttattaacaactttaacttcatccttttcctatgacaaatgagaaaagaattctgtgattcattgaacagtcagatttccaatatggtgtttacttgcattttcgtttccacttcagccaggaaatcaaatccgagggattaaataccccatttgaaatgtaatggagaattacaccaaaaaaggaaaattcacccacaaactagagcaacttcattcaaaatttcagatagtcaagagcgccagcgcatcgaggaacagtgacctaaccttcgcaggccgttggtgttagccctctcttaccttcctactggtgccatgaaattcactttctggcagtcatcatagctaatagtggccatgcattgaatgcgcactatgtgccaagtctggtgattcttatttttttttaatttaaattttacaactctgtgaagtagatacttccagtgtcccattttagaagaaggaatcagacaaagatagttatgtaatatgccgaagatcacagacatagtacatggtaaagtcaagttccaaactatcttccatatggctttagactgtaatccaagtcagcatttatgtgcatgctaccaggtcaggtatgatgggatgcctctttttacttaatatgtatattctgggggtctggctcctcccctggttttcactagagcaggttttgttctttttttacaccagaactctctaaaacccaaaggcataacattcacataatagtcaacatgtatgtatctcaagggtctactagagaccaggtaatgagctaggagctggaggaaggaaaagacattaaaaacaatggtcctgccttcatgaggcttacactctcctgagaagccagcttacaaagaagcaaacagctcagaaacaggttatgccttatgccaggtactaggaaaaaaatcaatgtggttgtgagataaaaaacaaggagggtttcatcgatataggatggtcggggaaggctctctgaaaagacggtgtttccactaaggcttagagagggggaaggaatcaagctggacccacatccatgggaagaacatctcagaggtagcagcaagtgcataggcctcaggttaggaacaaatgtgacctgttggagaaactggaaggatgtcaacatgggttgaatggagtaagagggtaatgaggaggactgccctagatggagtcaaaggtttgggtttaaacagcagaacaaacctattccatatctcagattattttgtctctctctttttttaaaaaaaaaaaaaattgttttccagtattgtttttctcctgtttcaccttattcaagcacctgctctagttcccattatttttttttaaaaattgctctctgttcatgtggaccttttaattcaagaaatgtttgagcattatatgccaagccctgacgtaggcaaggcagggatttgaaagatgtgaagtgatgtgtctgtgggccttagaaacacgtagctttgaattccgaaagtgagaattaagttgaccttgcagaaatgaattgcaggttaggtggtggtaagtctctaaagaagattcatgtgggaccttttcaaataattctgttctccagtcaattttaaaccaccctgcgtcccagcaaggacagtttatggctttgttcacatcatagatttagaaatcaagacctaagaaaggtcacaccattaaataaatgttcaacactccgggaaaaatgggatgttaataacaaattctcagttgagtgacattgacttgctacttttgtaacagctactttggtttgcatttgtaaaacctaaaaaaaatttttttctttacttttgttggagaaaagggaagtttttgacctgagcattttctcacttcagagaattgaataagggaagcgtgcattgattaatattcttgggggtgctagaaatgtatctgaaaacctctccagtctagtgtttctcaaattttaatgtgcttaaagatatctggagctgtgctgtgaagtcactaggcacatgtgacttctcagtacttctgaatacttgaaatgtagctagatgaaattgaggcatatctctaaaatgcacacatttgaagagttactatgaaaataaatgtaaaatatcttgacaatttttgtatcaattattcaatagaataaacttttgatatattgggttaaattcaatatattatttaatcaatttcatttatttgttttcactttttaaataaaatgcagctattagaaaatttaaaatcgtatatatcttacattatgtttttattttaccctattactctaagaagacttctgtgtccagccatgatgctacaactgataccaggttggtcctcagactgaaagcaatgaaatacctaaggctactctttttaagcattgatcaaaaggcagctctgtgatcttggagagaagggagacacctaaggtgagcctcatgaaagctctggctttctgtccaggagcccttttctgctgcaaggcaggtagttggtgccaagcactgtgacgttctcactgagctgaagatttgaagagtagagttctgggattctgaagtggaatcgttttggggtcaggtgccacaaaagaggaatatgtgcagggggaatgctcataagtctgcatggaattttacagctggtccttggctgactatccatgtccagggtgacagacttcaccggagatcagagatcagttgatgcagtgctctgagctagatggtaaaacaagaatctgtgcagtgctggggcacttgggatccaagcaacccagagttgggagaccttatgcaacaccttgtgcaatcaagtggaaaccccagaatgcccatgctgaggactaagttccagtttcactagaataagaccatgcctgttgactaagttcaagatggaaacagacccacctgacaaaggataaaacctagcacaacaggatcaaatgacactctagtcatttaaccacttgcatgaacaaaattcagcacctttcagaagaaaacattattagcacaatctggatttctataatgcattatgcatcttgttcaacataccacaaaatttattaaacatatgaataaacaggatcatgtgacctatagcaagatacaaaataaagcaaacagaaacagaccctgatgtgtcatggatattagaataatcagaaatgactttaaaaccacaattgtaaatatgttgaagacttaaagagaagattgtgttacttaaatgaataaacaagggatcccaggaaaaaaaatggaagtcataaaaaggaatcaaatggaaagtttagaaaggaaatgtaaaatatttgaaataagcaaggcacttgaacagtttaacagtagattgaagactatagaagaaaggactagtgaatttgaagacagaacagaaaattattcaatctgaagaatacaaaaggaaacaaaggtagtaaaataaacagagtcagagatctgtgggagagtatcaagtagtctgatatatctgtgattgaaagcatagaggtagggaggagagagagaataggatagaaaaaacagttgaagtaagcggtgaaaattttccaaagttaatgaaaaacatccatttacaggtccaagaagattagtagatcaggttaaatacaggtagaattaaaaaaaaaaaaaagaactaaactcagacatcagtcatattgacgaaaaaaaaaaaccatagataatattgaaaacagccagtgaaaaaggaaatataaaatgcaggggatgaatggtacaaacagtaactgatttctcatagaaactgtggaggccagaagacaatcatatgacatctttaaagttcagaaagaaacaaaacaaaacactgtcaacacagaattgtatgactggcaaaaatattcttaaaaattaggtgaaataaacacattttcatctaaaggacagtagagggaatgtgtcagcagcacaagaaatgcaagggacatgatcaaatatgaaaggaaatgagagcagaaggaagctctgatataatgaagtaaaaatagttgaaatggtagacacataggtctaccataggtatattaatgtatatgctttcacttctcttaatttatttggggaaaacagatagtttacaataaaaatgatacagttttattcttgggtttgttaagtatacacatgtaagatttatgactactgtgcaaatgtatgatgctgagtaggaaatacagttttattatagtttttatattttaacagaagccacataatatgaactgtaaaaagattctgataagttatggatacatattgtttatcctaccatgcctaaaaatgaatagaatatagctttaaaaataaatgtatatgtaatgcaaaaaggatttgcttaataaaaaagaagtcaagaaataaggaataaaatgaaacatatggatgtgaaaactagaaggcaaaagcttgaaagacaaccatagaaataatttcaccaagtgcaagtggactaaacactccacttaaagagcagagattgtcagactataataaaaagcaagaatccgttatttgctgactacaagagactcgtcttaaatacagagacacagttagattgagtaaaagagtggaaaactatatcccatatgaatagtaaggataagaaagctggtgtgtctgtattactgtcaaagttgacttcaggggaagaagtattagcaaagtggaaaagagacatttcagaatgatcaaatggttaattcatgaggaagatataacagccctaaatatgtatgctgctaataaacagcttcaaaatacatcaagcagaagttgacaaaactaaagccagtaatagataaatctgcagtcatagttgtagacaaatttgcaatcaacaactctctctgattgaaaaaacattcataaccagatcagcagtgatgtatgcactgatgtggatgaatctcatatacattataaagagcgtaagaggccagataggcatgcatactctatgtttccatttatatgatgctcaagagtagaaaaaacaaatttatggtgagaaagttcagaacactcattcctttagagctttgggttctgactaggaaggggcaccagaggactacctagtgtgatggaaatactctgtgtttgatcggagtgttagttatatgtgtgtacacatttatcaaaagtctttaaatctttattagcctaagccccatgtattgccacttgtttttgtaaacaaaatgttattggtactttgctgtactgatttatctacgtattgtcaaaggctgcttttgcactaaggtaacagttgagtagtggagatagagactatggcagaaaaaacctaaaatatttatgatctagccctttctagaaagcttactaccccttgctctagagtcacttatttaaatgcagcttctgaaagtcaccctctaagattctgatccagaacatctggaacagagggaagcatctccaatctattccactccccagatgactctcaagtttataaaactgtgtggacagaagttgcggaattgctcctttcaagattcaccatatcaacatagtagctactctctttggtcataaaggtattttactgactaatctcattgaatcactctggagttataaaagcccatttcctccccactggccttccttggaaagtgagaaaaattccttctcatcatagttatgtaatcatccttcataaatgtggagaggctcacatgtgctgctggtggtaacacattctcctgccactctctggctctctgtaggcggctgtttgagaggttaaagataggatgaaggaaaaattcacaaaacactttgtatgcacgtctggcggataatgacacttaagaagctttgcttaaaactgatctgccttcgtgatgatttgagcttgctctttaattagcttttaggagcatatattgtttagtatgattattttattttgccaaatagaagcttaacacgctttagttcacaaaggagcgagatctactttataccagcttttaacgaccaattgagagagaagaaaatgtctgactgccctggaacctttttccccatgggtggtatgtgactttaagatttcacgatcatgggggacactttcggcagcaacagcaatgctcagcaagtattcccttggctcttctctatttccagccccctggcagttaggtggagctctgtgactagttttgctcactgaaatgtgtgacttgtccattgtttcttctagcatagaatcatgcgaatgcatgatgcagttaccacagcatgtagataccacagatacggttaccacaggtgtgacatgaagcagcttgaattcctgagctagttttactgagcaggaaattgatgtttgttgcgttcatttatcgaagtcttggagtcacttgttagtatggtatagccttctctttcctgaccagtacggtacctactgccataagttcagttactcactggggaacatagtccaggagtacacgtgaagctagtaaaaaggcaccatttcaaattagcgaaggtggcatggactgtgagttaacagaggaaggaaaagtgactgtatatttgggaggaaaaagtgagatctctttcttcaactatgtaaaaataagttatatcccagcactttgggaggctgaggcaggcggatcagtaggtcaggagttcaagaccagcctggccaacataggaaaatcctgtctctactaaaaataccaaaattagctgggcatggtggcgcatgcctgtagtcccagctactcacttgaacccaggaggcagaggtcgcagtgagccgagatcatgccactgcactccatcctgggcaacagaacgagactctgtctcaaaaaaaaaaaaaagaaaagaaaaaaaagactattgcttttcaaaaggtctctgctgtgcattatgttgtgtaatttttttttttttctgagagactgcctcaaaggatgcaagttattcgtctccatgtcattttaaaaatgtcttctctggaggtatctggatggaagagaaaacttctgtgatgctggggctcaattctcttggggctctctataagacaggccattatatcaattgctacatctagcatctcctgtgctgacaaaagtcccctgattgctccactgccctgcagagttgattgtgctatcttcctcgcttgcctgatactggcttccacgttgctctctctagcatgtggacttcagaggcagagcctgcgttcttcatttttagtgcctatcaggcatgtggctggcactgaacacagggttctgaatgaataaataaatgaaatgcttctaccacttacattccctgcctcttgggatggcaccatgcccagtgcaccaccctgatttaagttagtgtcagtcaaccctgccttgattcctgcgatcacgctatgtttactgttacccctccccattagttctttcactgaagtcagggaagatctgtttaaaatccatatcttatttcactccctacctaaaaccctttggtggcttcccattgctctttgaataaaggcccaagtctttaatgtgccacataggacgccatctctgcatcctcaccttgctcacacctggtagtcaggaaagatttattccttacagttgctgaaacacaccctggtctatcctgccacagggtctttgcctgtgctgtgcttcatgcctcatgtgccccaagcaatagtacacacacacacacgtttgcttacctagtctacttctaaattactgtttagaccccagctcaaattaggggacattcctcttttatataatttgtaatttctttcttttctttttttttttggaattggagtctcattctgtcacccagggtcaagtgcagtggcgcagtctcggttcagtgcaacctctgcctcctgggttcaagtgattctcctgcctcagccccccaggtaactgagattacagatgtatgccaccatgcccagctaagttttgtatttttaggagagacagggtttcaccatgttggccaggctggtctcgaactcctgacctcaggtgatccacccacctcagcctcccaaagtgttgggattacaggcgtgagccaccacacccagcctaatttctttcttatagtattcagcaccccttgtttgcagcagatattgtggttgcagttttacgtatatttttacggttattggattcaggtctgcaagcacaaaagaggatttgtctggtttcagtgtaatcttgcaccccaagaaccgattacaggatctgatggatatccactcaacaaataatcttgtgtaaatgaatgtcttgttaggggtattgtactagttccctgccatccagggatgcatagtaaatctgcctgatcctgtgagctcggggaaacctaaagctttctgcgggagtggtaggtaccaaagacatgacattagttctgccctactcagaaggtatgggctgggacaggcagtgagggggtgaaggagactaaccgtgaactgtcagtgccccct[136 bp omitted]aactcagagtatttcttatgtgaggggtccattctctagcatcttaccccaggcaggccattttttttttattattatactttaagttctagggtacatatgcacaacgtgcagggttgttacatatgtatgcatgtgccatgttggtgtgctgcacccattaactcatcgtttaacattaggtatatctccaactgctgtccgtcccccctcccctgaccccactacaggccccggtgtatgatgttccccttcctgtgtccaagtgttctcgttgttcaattcccacctgtgagtgagaacatgtggtgtttggtattttgtccttgcgatagtttgctgagaatgatggttatggtagtaggttttcagaagccatgcttcagttctgactggctaagcattcagaaatgggtcctaaacagcaaaatatagatggcattccaatgcacccacagaagaggttttcagctgcagaacaggcattctgagttaaaatatctggttgttttctattggaaagcattggctgtactttgaaactctttaggcttcattctgataagagaatgagatgacaaggtaccatagaattcagtgcaggtattattattatttacattttgcatttagcttgttttaatgaggaagagtggtgggagtgtataaaattttgccacttgtcctgaatcccatcatcattttgaggcaaattggagggatcacagattcaacagggtcaggtgtgaatatggggggtattcattggatatttgaatgaaaacattggtctgtttatttagggtttaaaagtatgacttaaatcattgcatttaagtgtaggtaaatcagaatgtctgaaaaaaaaccatgaacactaatagttaatggaacaatgactaatcataaggaataaaaagtgggagtagatttaaacaacaaaaatctcaagtgtggctgaaggtggcaggggaattcctggagatggcactcgtttcgactttttttttttttttttttttttttttgagacacagtcttgctctgtcgcccaggctggagtgcagtggcacgatctcagctcactgtaccctctgcctcccaggctcaagtgattctcctgcctcagcctccccagtagctgggagtataggtgcccgccaccatacccagctaatttttgtatttttagtagagatgggttttcaccatgtcggccaggctggtctcgaactcctgacctcaagtgatctgcttgccttggcctcccaacgtgctgggattacaggcttgagcctctgtgcctggcctgttttgacctttttgccattgactttaggtactttgttagaccattgctaagctcgcgatgataacacctattagaggaagtcttctgaaagtaagacctggagattcggaggcgatgtgtacttgcttccccagcagtccaaggtgtatgtcctgccctcctccggcagggccactaccatgctggctccccttggtttaggcttgactttgcctttgatacaaccttcccccaaggcaccctgtaatcgcagttgagccgtattccagatacgtgtgagccatatgtctcaggtgttgcagagtaggaaacaagttgagacatactgaggcaattacagaaaaaaagaaagcatggagaattgcggtgataagggcttacgcttcattttttatgctgtctcttttctgaccatattttagatttcctagaaactacccattattatgaatgcctgagttctgtgcatttcttcagagctcaagtctaaactaatttaatgtaaattatacatttgcaagtaatattccagaaaaacctttatggggcccacaaagacaaaatgcacaaaaggaaatgatgatgtgttttattcataaggaagcatttctcttcaaaattcttctacagccccccaaaatacctaatgcatcacaagccgacatttgtactgctggctttccatacacagagaagtactgttccttttaatcaagtaagtttattttgctgtgaaaccctttgtataatattgaaaaatagttgtgttccttggaagctatttcagttttctgaaatgatcatttttaatcagtctcctagcaaaacaatttaccaagcagtggaggataacgaaccataaagtttaatttgccttttttaattgagttgttaattatcacccctccaccgctggaaactcccaacttgcttttttgttttgcttctgatccgagacgttttcaagaatctaatctatcatatttcctctgtccaggtactttcatgaatcacatcaataggtgattattttctaaatctgttaaagcttccacagttgcgtacaaattttgtcagtggtaaataattagatagaaaacatccagtggtggtaagttgataaagatatctgccatttattgaattcctactatgtgccagatgctgatctaacttcttaacatatattatttatctttcacagcatttttgtttgttttgttttgagatggagttttgctcttatcgcccagggtggagtgtagtggcgtgatcccggctcactgcagctgccttctcccaggttcaagtgattctcctgcctcagtttcctgagtagctgggattacaggcactggccaccacgcctgggtaattttttgtgtttttagtagacacggggtttcaccatgttggtcaggctggtctcgagctcctgacctcaggtgatccgcccacctcggcctcccaaagtgctgggattataggtgtgaggcactgcgcctggtcatttttttttttttttttttttttttttgacagggtctgactctgttgcccagactagagtgaagtgacacaatcatggcttactacagcctcaacttctggggctcaagtaatcctgccacctcagcctctcaagtagttggatgtatgcaccatcacacctggctaatttttaaaattttttgtagagacaggttcccactatgttgtccaggctgctcttgaaactccggggctccagtaatcctcctgcctcaatctcccaaagtgttgggatcacagacatgaacccgtacaccaggccttcacagcattttgaggtacaaacagttatctccattttatatgcaactaaactgaggttcagttatgttaagtaccttttccatcacaatccaacttatcaggactggagcaacgcttcaatcctaggtggtctggctagtggcctcacaggttatttgtttaaccctaagctgtatttttgagatccctgatgtcaaacaaacctgcatttgaattctagttctatcgttaatattgatattaaattaacagaatatgacttagggcccatttgatgggtgtgcggtctgggcccctgcccagccacaccctgcacttggtttgatgttctgctgttgcctttctggcaactctaaatcattttgaacaagggggccccatgtttttattttgtattgggtcatatgtaacataggtagccagttccaataccattattgttttaacatctttagaggctcataaggctgaagtcaacgtgtcagcctggttgggttcacatatggtggcttaactggtatagatctacttccctgctcatatggtaacattcagttccttgcagtcataggatttgtggcatgtttgcctttttaaagccaggaaggggagagagaacgaccagggcaaatctgctgggaagatggaatcttatgtcagataacataataataggagcaccatggtggctcacacctgtattcccagcactttcggaggctgaggcggacagatcacgaggtcaggagatcgacaccatcctggctaacatggtgaaaccccgtctctactgaaaatacaaaaaattagcaagggttggtggcaggcacctgtagtcccaggtacttgggaggctgaggcaggagaatcgctggaacccaggacacagaggttgcagtgagccgagattgcgccgctgcactccagcctgggcgacagagtgaggctccgtctcaaataaataaatacgtaaaagagcagcatccaatcaccttcgctatattttattggttagaagcaaattacaggacttgcccacactgaagaggagggagtcatacaaatgtgtgaacatcaggaggcagagattgtggggcaccatcttgaagtctgttacctgcaattattattattactatatacagttattagtgttgtttttattaccgctattgttattgatagcagttctatagagtactgtgtcccaggctctgctgtgtgagctttatgtgaattaaagctttctgtgttcagcagggaccatggtcctgaggactgaatccaaggacatcccctctctgcccactgaaatcagtagttttcaggccaactaagcatgaggcaactgttattttcctgagtgatacgatcgtttcaggaagtataaggaggtggaaacacagaattctgcatcacacagaccaaggtgaggtcccaactctgctgctttctggctgtgtggtcttgcccaagtcactttctccatgtgggatgttccaggagacttttgaccacccgctgcaagagaaatctcttacaacctgcccattcagcacagttcagcctgaagagagtcatgtgtttgtatttaagatactattaccctgctcaatcccaagagcccactggtctcaggctctgcatggtgtttgaaacaaaaaaacacaatgaagaaatggaaaagttatcccccaaattgtcagcacccatgtaactgctttctcctctcctctgtgattgtccatgaatatagattggcttggccatgccatcttttctctactagcctctttcttgctctcttcctcactctttctgtttcttggtcgtttttttcttgatttctccttatgtatctgtttttgtttctccttctcctgtcctgttccccatttttatccaaatgccatgtcagtgattctcccttctcaggaggaaggaagcagaaaagggtggacaaaggaaataattgaatagaattccatcagtctctcttagcaggtgtatctctgaagctcttcaaagatggtcttgatgagagcagaggaaggaactgctcctctcaagattcagctggaaaaaatacggaatattgtgttaatttgtcttaccaaatgctcttctccccacgttttccctttgatttctctgaatgtttgggaggcatgcattttgctgcagaagagaatcaagtcttcttacaccatctttgttaagatactactgtctgataattcgtaaacttctaaggttttttttccactggaaatgacttttttttttttttttcttttgagacggagtttcatgcttctcacccaggctggagtgcagtgactcaatcttggctcactgcagcctccacctcctgggttcaagcgattgtcctgcttcagccccatgagtagctgggattacaggcatgtgccatcatgcatggctaattttttaatattttttttgtagacacgaggtcttgctgtgttggccaggctagcctcgaattcctggattgaagtgatccacccatcttggcctcccaaactgctgggattacaggtgtgagcccctgtgcccagccagaaatgcttctactttctcctgtagggtggcctgtagcaggatcatccattcacattcccaagtatcctctgttcattcacctgggcaatgagaggagcaacaattaagccagaaaagatttgctgcctccctgtcttgatcccaactccttccctcctgtctgtgtaacttggatctcttacttgtcccctttgtcaaggatagagtcaatcccattccttctagtagatcttcccttctggcccaggagtacctcatcctataagcaaaacatctttagcatctttcatttcttcaagctgtgtttccttctcacttctgaaaaaagagcaatctgtggtttggtttcttatctctggtcacccatttactacccttttaatctgagtgctgtgcaaataaccatctcacaggtgaccaagggacactccagtggtcaatgtgtagtctcagctcgtattctccccaagctctctgcagcgtcagaggacactgacccacactgtgacttgactctctgccctcccacattgttgtgagactggagctctgcgtcattttcatcctcttaattctctgtgtccatccccatgtcttctctctcaggcacaggctaaatggaggtggtgctcctgaacttgaccctcctttgtctttttgcatttccctgcagtaccttagcccatcaccatggccgctgcttttggagcaccttctaaatgtcagcctcttttctcagtgccctccatatgtaaacccttctaatcctccctaacactttatgagataaaaatgagggttgttcttttacaagggcgatacggaagagctgagaggctattcctttctttcagatctctgggcataaccctgactgctctcttagattgtctttgatttctgcttgtcgcttgtctcctccccctgggttatctgttagggaccacactcaaaaccaaactcacctccatttctcttccaactatgttcatcctctgcgtcctgtggttttgttcatatactgctctaagttccattcaacacttcctacatcatttttgtgacttcctgtctttccctgcttgtccaatccaccactaagctgtgtttatttcactcccaaatattttcctttctaatttcttccaaattccaaaatattcttttcagccctctttaattctcttactgtaatattacaataagtttcttttaaaattaatttcatttttctccattgtgtaattattgtatgctgatctatttggagaaaaggtgaaagaactcttttttaaaaatctgtaatctcagcacactttgggagggtgaggcaggcataacacttgaggtcaggagttcaagaccaacctgaccaacatggtgaaaccccatctctactaaaaatataaaaattagccaggtatggtggctcatgcctgtagtcccagctgctcgggaggctgaggcagaagaatggtttcaacctgggaggtggaggttgcagtgagctgagatcatgccactgcagtccagcctgggtgagctcaaaagaaaaaaaaaatctataatctcatcacctggaatactgcttcttgcttctggcctgtcttacttctcgatccctgattaatttctctaaaaaatcagcttttctatataacccccttcagagatccttgttgctgctgctgcaaaaaaaaaaaaaaaaaaaaaaaaaaatccaactcttttttttttttttggagacggagtcttgctctgtcacccaggctggagtgaaatggcgtgatcttggctcactgcaagctccacctcctgagttcacgccattctcctgtctcagcctcccgagtagctgggactacaggcgcccgcctccgcacgtggctaattttttgtatttttagtagagatggggtttcaccatgttagccaggatggtctcgatctcctgaccttgtgattcgcccgcctcggcctcccaaagcgctgggattacaggcgtgagccaccatgcctggccaaaaaaatccaactctttagaaaaacactcagaacattccaagttcccctagaagataactttcaggaaggcaatggctctgccttttgaccagcacatagatgaatgccagaaacagagtgagtactgattggttgaatgaatgagtgaatgaaggaatgagtgaatgaggaatccatttaccttctctaatctctggcttcatctagaccaaattactgccttctcctaaattgttccatattttccacttcttctcacttactgttagtagctgagatctcctcctgtccatctcctttttgtttgtagatcgtctctgtcattcaagactcaactcattcttcggggcttcctcaaaattcccctgatgttctctgactgcaaggagctcttccctctcttccctcctctgttactcctgaagcagtttttagttttcattctaattcctttctcccagctcctgagcaaggtaatagtattttttcagctcggctcttggtagatatttaatatttgttaagtgcatgagttcatgaaataaatatttgggataatggagctgaagttaaaaccagtaagctccacttacttctgtgtctgggccacactttgtccaaagatttccctcttaacgtttttgtttacaaatgctcttcaggaataacttgtaagagaaaggagctgtcattgagtgccttgaaaagtggaattgcatgtttctatggaaacagagttgagagctgagttttctgtacatgatgttttaatgaaaacatattcttagccattatagatgggtttgtgtaccagatgagaagtgctttatcttaattgaccattatgttcataagtcagattgatggtctcaagtattatttcatcaaatcacaatgcattactgtggtttcctttcaggaggtgatcccaatgctcacaaaatgaaggctgtccttgtttgtggaggaaaatgtttctatagacttgctgttcttccctttgctattgagaagtggcctctttatttatagctaaaggacacttaccataagcatccaagtgattctgttctctcttggaggatgataattgccccaaatcatgcatgtatcttatatcatatgaacaattgttaagcagttttagggactccaggatggtggtagcagcggtagtggtggtggtgatgtgggaaagctcaaagtttgctcccaaactcttaagtagaagactacctgtgcacctgatacttttgcttttcacttgtgtgtttgttggttttgttttttagagacagggtcttgctcttttgcctaggctggagtacagtggtgcattcactgctcactgcagcctcaaactcctgggctcaagcgatcttcccacatcagtgtcctcagtagctgggactgcaggtgtgcaacaccatactcagctatatatatatatatatatatatctctacctacctacctatgttgtccaggctggtttcgaactcctggcctccagtgatcctcttgcctcagcctcccaaaatgttgggattacaggtgtgagccactgtgtgtggtcacacctaccatttttggtttgtactagttctgaagcatgtattcctatagcatggatcaacaaattagactctacagattatatccattagaatgccatggactataagtgctgggatcataattagaaaattattctctttttaattttctgttaatgataatttattaggcatattgttcctatccagagatgggcttcctgcttcagtttgtggcaaatttagggtaccattttgcttacctcttggagatctcttttaatgcagagatctaacacatcattctcctcaagtaccttttaataggaaatttcccaataaacctattaaaagcataatgaaaacctcattcagtcttctgtcaggctttggagctataagtggcttctaatttgcacaagatcggaatagcattgaagaattacagtaactaagtgaaacatgcattggattttcaattttctgatagcatcccatgtaatttcttgtaatgcatctgtagccaagggaggtgacacatgtcaaggctcacgctgcagcttctgcccacatcagtcttccgtggagaagcacgatgctgtcagcttttctcatgagcaggggccagataggtgtctttgtttagccttgatggatattccattatgcacagtcctctgagcaatagccacataatttaaaaacagctcagatagatgtttttgatgcttgacatttgacttcacatatttattggaacaaactgtgaatcatccctcttatgcaagtgcttgacagaatagtttgtccacctgtggtctgttgtacctgtggagtctatttgtattctggaaaatgaattccctctaggaaaagccaagagaagtcctggacatcatggctacaagccagtgagataagaccctgcattttattttttttaatcatagtatctcttttttttttaactttaaagttcatgggcacaagtgcaggtttgttacacaggtaaacttgtgtcatgggggtttgttgtaaagataatttcatcacctaggtattaagcctactgcccattagttatatttcctgatcctctcccatttcccaccctccaccctaggaaaggccctgggtgtgttgttcccctctatgtgtccatgcattctcatcatttagctcccacttataagtgagagcatgcagtatttggttttctgttcctccattagtttgctaaggataaaggcctccaactccatccatgtccctgcaaaagacacaatcttgttttttttaatggctgcatagtattccatggtgtatatgtaccatattttctttattccatctgtcattgatgggcatttaggttgattccatgtctttgctattgtgaatagtgctacagtgaacatatgtgtgcgtgtgtctttgtattataatgatttcttttttggggagtatatacccagtaatgggattgctgaaaatcctatatttcctttggcatatttcattttatccagatgaaattatccactttccctcttagagagcctaaatgtttgtttttaacctgaaagagggagtctcttgtaccttacctgtagtattttcaatgtttatggcatacgtccattatttaaaacctcaggaggagaaaagccagtagtatatttaaaaatagactaatcacagtttgcaaaggaaaaaaagaaaaaagaagccaaccagactttgtaatcattaaaataattaatggtgttgcttttcttgtatgtggccttgacaagactctctcactcctggggcaggtattttgactgatttttcacctgactgaggatgaatttgcactaatccagctctatactctcccaggatctcctttgtgaccaaaggcatttatttgcaaggtagcagtgtggaggttaagatgataatctaaggccagagacagcgtccagctaattggctttacatggggatccaagctgtgttctaactatggtgcttacgtagcctgaagcacctttctgaccctttatatcaccccgaaaacagcaaacatttgttgaattcccatgggtctggtgctgtgggagggggtggaggcaggagaagccaggagagactcagcttggcacagcaggagcttcttgggtgctcacagcagataggaatccacgcttctttttaaaatacactgaagaaaatattatttgagtctttccatttttagctgttcaatgggtgataatggaaagtaagtccagattagcctccaaaattgtagatcagctgttttcaacctcaacactattgacatttggggctagatgattttcactgtgggagctgtcctgtacattgtaggatggttggcagccgtagatgctggtaaaaccccctctagttatgacaaccaaagagtgccttggctgagaacccctcctctggatggcttcccagtggctactgatactggcattttctgcttttagagagagtaggtgactgttttcacaagtgtaaaatataaagtccttaggacgatgctgggcatggaataggattcaaaagtaaaagggcaaacttttcactatactgaatcaagctgttatttttttgaaagtgatatcatcatctttgctgttcattatacctttactgaaccttccggagtgtccctgtcttaataaagaagtgagcatcgtctaagtactgttttgagctttaagtggcgattcaagctccacctcgttgcagaaacatgggcagtaaaactgttagtatctgagaggcatcaagaaatggtagacgattctgaagcatggcatcacgtggctcttcatgtttatctcgccacaacatccttagctcctcctcctcccactggtcgtgcattaaagcttcaccaccccaagggccatctgtagactcactgcatcagcatcgccttgggagcttgttagagatacagagactcaggccccagcttccacccacggaatcagaatttgcatggatagagagccagagaaatactttgttgaagggccttttccatcccactccaactgttacctaaaaggacctcttcagagcctcctttcatagatattctgtcttgctggctgcatgctctcttagcgtcctctgctggccgctgttgatggtggtgattgtttttcatacttttccttccttaccattctgtgctctcataagtacaggccagttttgcttttctgtgatcccaagctatgacctaacacaaccctttcccatacagatccagtcccaagcacccgggagcattccagggtccctggacatggttctgcaaaactcctagctactcagcatgccagaattctaattcactcatgggtcaaagccagagaggctgtgtgtccacctctacacatatgtacccatgttgaatttaaaggtccccaataggagctacctcaaaaacacccaacaattaaaactagaggggatgggggcaagaaagatgaaaagaaattgattttcaagatgccatcaaggttggggaaaaaaagaaaaaaacaaggaatggaagggacatcagacttaatgcctccttgaacatgttacgttcaactcaaaagcctccccagtcctcgcaccaaaatctttcccaagtttgtaattggtgtcaccatccactcagttgctgaaattaaaacctaggcattatgattgattccttctttctcctttcagtctatcaacaaattgtatgtttctaccttcaaaataagaatctcaaatccccccacttctagtcatctccattgctatgaccttgccttcagtcccagctctcaagggtctcctacagccttctcctaaattgatcttcctgatccactgttgccattctcagaccctccctttggcagaagccaaaggctggtttctaaactggcagtgtagactgggcacggtggctcaagcctgtaatcccagcacttcgggaggccgaggcgggtggatcacctgaggtcaggagttcgacaccagcccggcaaacatggtgaaacccgtctctactaaaatacagaaattagccgagtgtggtggcatgtacctgtaatcccagctacttgggaggctgaggcaggggaattgcttgaatctgggaggtagaggttgcagtgagccaagatagcgccactgcactccagcctgggcgacggagtgagactccgtctcaaaataagcaaacaaacaaactgccaatgtgctggtcatacttccttgttcattttgtttcacttttctatttctcaaactcctcaagctcattctagtcttagaattttgttctgctcccacctcctggaacactcatcccccagctactggcatggatggctcattcttctttgagtctcaggttgaatctcaccaccctcaaggcaggaaaaccttatcaaattaggaccaataagagtcatgttcctggcacctaggtagtagatgaatcccctttgactaaggctacctcaccgagtgactgtgttctctaaaatgctggtgatgtagaacaggcaggacacagttagcatgggagacccagctagaaaaagctggagagatccagagtaaagttcatttgccatacttcgctttatctaatagtgagaaagattgcctatcaattaaaaccacaagggtggagtggggatgttttccctagagatttgaagtagtttcatctaatgtggagcagttttagaattcaataatgcaatcaggttttagtatttccacccccctccctgccacgtaatgattcatgtgccttgaaattttttcattaaaaaattccaaggctcacaacgtagaagaaaaaaaagaaaagggggcctcacacctcatttgttcagccatctcatcgaggccccaaatgtagatcattgaaatggagccttggaattttaaatcaagttttactttgcaaatttaatgaaatgcaaacaaatacttagcagttctaaagggcatgaagtcattaaggtttctcattttgttaggcgctttgggggcctccttaatttttggagtaaaatcaattaagttctttgtgtgtgtatgtgtgtgtgtgcgcgcgcgtgcgcggatgtgtgtggctgcttgtgtagccagtaaatagacgaggtgtactttggatttgaatgtctgttgttccctttaccagatgtgtgtccttgggcaagtaacttaatcttgcctcctatgtaacatgaggaacattgaagttttgctaggaggattcattgcagacgcacaggtttctgttcttagaagtacccgtgtatgctttaatgctttgcttttaccatcttgaaattcttagtaattattccgtgatgggacatgcattttcatttttacataaggccccagaaattctgcagctggtgctgactgggtgaaataatgtgagtaaggtgcctgtgagcatcccttagatgaggcagatgctagatatgcattgggtctttttcttccaggtttgaatagctgtgtcttgctgctttcctgggttgggcaaaatgtagaatactgacactttatacagccacccccataagagatgcaggttatctgttgattacctttaagactggagaaagatagtcgattctcttacctgcactttagcaatgttgggaggatagaacttatttggagaacgtttatggcctaatagcttggtaaaatgtgaatcttcatgaaagtggtttgccaactctaaattgctatacaaataagtcctgattatgtgcactgaacaaaaggcttattgagcagtaactgattcagatggaggtaagaaaatatgccaaactcttaggggatcgcagacattcaaaatcatagctcctgaaatgtgagcatttctctgtcaattcagcagatgtagagcgcgattctatgcactgtggggcaaggtgttggaatggtagatgatgaaaaatcatggcttttggtcataggaaattatgtgatgttagcagcctagagctcacagctgaggctgctggaggtaatgctgagaggaagcatatcgtgagaccagagagggttgaagagaggatcttgagatctgtgtgcacctgaggtcctcaattttggattaacagaatccccaggaagtttacccagattgttatgacttttacccagagtgagaaccatcattgattaacacttaaagggcctggcagagaaccaggagagaagagttgaagttgtgaggatctatctcaaggcatgtgtaaacaacagtgcccaggtgagaagtggagctctacttctggaaattctttcctttctgttttccattaaaaaaaaaataagataaaattagtgcctatgttgaccagctctgttctctatgttttccttcccaaatgaaccaaatgaatgctagctcttgcaaggccaacatcacagagaggtgttattcctgtccccctttattttctctgcatattctgtttatttcacccacagcatgacacacttacggaaattatctcattgctggtcctaatgatcttttcccttcctctttccacggctggaatctaaaccgcatgagagctggggaatgggtcttgtttatctatctctctatccctaagagctagatttgtgcctaggacatcagaagcctccacatatttcttgaatgaatgaatgagccagttttcctcacctgagaccatttgcagcatgtcaggttgtcttgacgtgcagctgaattatttacattttccggcaattcattgattgacaccttgggcgccctacatttgtgctagcctcttggtattttttctcccagcttagatgttcctgctgttctccaggatgggtccttcttccttacagattcagaaaggagaatcttctatgaaatctacaagatcctactagaacgtcaggtctgaagggcaggactatgactatggtttccttattcatcatccctccataaatacatatttgctgaatctcttttcctcccttactcttcctgtatatagaagaggaggtggacatctatttggggtgttctcccaagtttgtggccaggcttaaggaaccccgcgacaccatttgttttcaggaa[134 bp omitted]ctgctgcctcagcctcccaagtagctgggattacaggcgcgcttcaccacacccggctaatttttgtatttttagtagagatggggtttcaccatgttggccaggctggtgttgaattcctgacttcaggttatccacctgccttagcctcccaaagtgctggggttacaggagtgagccactgcaactggcctataatcagtcttttatgtcattctccatcttcatgcatttaatagattacagcccaaatatcacaatcgtaattgaaacagatttgtttgttagaagagggggaggtattaatgaggctacacaggcactgctgtgaaccaggaaaactacacagtgtgggtatgagggagtgaagaatacatttatgttttaggtctcacttctttctttgcctgtattaagtagtaagggggagaactaacaaggtacctctgcatttaatggttcttttgcagtttggctgaactgtgtcttgaaatccttgaagagcattactaagatggtatagaagttacttgcttaaaaggagaaaagaaaaagctttaatatagacaactcaatagctgaactactcttgcaatgtgaatagccattccttgggtttctaaatgattttcacacttcccacacttgtttaaatttgtaatatcctttatggttttcctttattggccaggagaagaaaaacaccctgaagatctaggtatccatcaaagctgatggaatacactaataaaatcctgtgtcatattaaaatgtaaaatatatgctggcataatattgtctgagtcaatccaatggaataacataattaatagtggctttgataattaatttataggaggaagaagctgaggacagcttagttctttctgtctctgtattcctcccaccccctcatcttttctcctgctctctgtctttctctctctctctctttttaactagctgctgtttgcttcatccaaatatgcatggaaaagttttaagtggttgttgaaactcccagaggcctgtttacttcaaggtagaagcaggaaagctgccataattcagaaagcagcttctggcatgagatgaaagtcagatcagctcaagttggggtcagaatttagaggccccactggagtgtttatgcttgtatctgtagtccagataagttagtggaagaaattgttccctgtggcaggtcatgaatctaattacactagaaatattactacaagcgcttcattgaaaattgctaagcaatgtatgctatctatggctttcgtaccttcaaatcacatatgatatgtggaacacatcttccacgtgggcccacagacccataactcaagccatggtttctcagcagaaaacagaccccagagagctcctgttcctgaacatctgtctaaaaaaatgccctcttagagatgagagaaacagagaccttacttgaacaaagagagaggagcactgaagtctcaggagctgatcaggaaacacagaaaggaaataagtcgatggttttaagagctagctcagtgccacccatgttgcaatgtaggttctggatctaggcctttttcctgttttatgactattggatatctctcttaaaaggggcatagttattttctgttttttttttttttttgttaattttatgtattttttatttccataggttttgggggaacaagtggtgtttggttacatgagtgagttcttgagtggtgactcctgagactttggtgtacccatcaccagagcagtataccctgaatccgatttgtagaaacactaagcaaaagaagttccagaacagaattaaaactatgcagcattcctatttcctccaataaaaatttataattgacccttgttagcaaaaattttcaacaatggaaacattgagaatattcagtaaaacaaaaaacaaaaccattttgaatattaaatataaaatattgttccttgctaattgaattcttttttaaatatggaaacacacaattgctttttattaccctttcatttttttacattgttttgtatttgttcttatattcaaatgaacaggctattttcaagttaacacacagtcccactccttcctccaagttcccaaagtccattgtacgttttttttttcccccttgggatggagtctccctctgttgcccaggctgaagtatagtggcatgatctcggctcactgcaacctctgcctcccgggttcaagtgattctcctgtctcagccttcctagtagctgggattacaggtgcccaccaccatgcctggctaatttttgtatttttagtagagacagggtttcaccatgttggccaggctggtctcaaactcctgacctcaggtgatctgcccacctcttcctcccaaagtgctgggattacaggtgtgagccaccatgcccggcccattatatcatcttaggcttcgcattcttgtagcttagctctcactgatgagtgagaacatacaatgttttgttttccattcctgaggtaaggtgacctcgttctaattttatcaaatacagtatgtcaagcaacaacacaataaaacaaatgggtatagttatatctggtttgaatagaggctgtgggttcaaaatgaggataagtccagacctcatggaaacctccactggcatagcctggtgattcacacaggaagggttttgaaatcagatgttcctgcgtcataatctcacgctgacgcttactaagcctgtaacatcatgcaagccagttatctctcagcctggacttggtcatctgcaaaatgggtaactgtcacattacttgccttgcaaggttatcaggttggtacaaaagtaattacggtttttgcttttaaaggtaatggcaaagattgcagtcacttttgcaccaagttagtataaagataatggtataagcaaggttatgaataagtattttctatgttgataattctagatcagggtattgtatgacatgtaggcattgtaactgtaaaataactatgacgtaggcagggtattgcatctgaataagccaggtagtgaatctattatcctacaggtagattctttttttctgtaaggtctttgaggtaaggtaggaataaggatagtgggagccagcggtgatgaggatgacaagatggtctaaatcttctccctctctggcattattgctgtttatttccttggagagagaatctactcttggtattggaatcagaagcagggaaactaagggaatgaatatgaatgtcaaagaagaaatgggatgcgggtttgagcaaagaaaatattagttaatgaatgttttaggaaatttgcaatgtctggaaggtaaacgtctttctcattactaatgtgactacaggtcgtactgtgtgttaatttgaaaatagcctgttcatttgaatataagaacaaatacaaaacaatgtaaaaaaatgaaagggtaataaaaagcaattgtgtgtttccatatttgaaaaagaattcaattagcaagcaactatattttatatttaatattcaaaatggttttgttttttgttttactgaatattctcaatgcttccattgttgaaaatttttgctaacaagggtcaattatataaatttttattggaggaaataggaatgctgcatagttttaattctgttctggaacttcttttgtttagtgtttctatatacattttctaggtagaataaaatccattgtacatattttaaaaaggaaaaagtagtccggagtgagtccttcccattgactgctttggacattacaatctgccatctcttcctctggggcatccaggagacaagccctaggagactgagacatggaatggtgatttcataataaaacaagagacaacagggcaattcagtgttcagcgccgtggagctgtgcactgttgaggaacacatcagggcagcctggcccacagatttagaaacagagtgagactagaagggccatctgctgagtaagtagagacctcaagatgtacagcgtgtgttttatgatccggaaggtagattttccccccgttcatgtaaagcacttcaaggacttggtaatgggacaaggagcttttaacctccaggttactggttaagaaatgtcccacatcgatagtgaccagaaggcattgccgtctgctggctgcgcagtggcctatgtaaatgactttaaggtctcaaagcaaaccattatgggccgactttctatcccaccaactcttaactccgagtacaatgacccagactcagactccttgaagtagtccccgtggagcctgatgggaggacggcaggtggctaacagcggcggcttccatgtgggactctgctgtggcaatgtttttttttggaactcacttatttttatagtttaaaagaacacactttatttttcactctggtgagagactttttaattatgtcttttgctgagcatttcaagatggtatcagcatctgacatttgaaatgccttctttgccaggcactctgataagtgcttaacctgtagggtatcatttaatcctccccactcttcgtgagttagaactctgtttcttgttttataaagtaggagactggggcagagaaaaatgaggagatctgcctgaagccacagaagcagggtaggattcaagacctcccctttgtttagctaggattcatgttcatttctttattccatccaattttctaaaacatttttaagaatcagtgtccctttatgtttttcctaatagaggtttctgtgacctcttagcacacatgaactaatgcaggaatgtgcagacactgtccgtcaccttcctcacagttacctctcctgcttcccccacagctaatggaacattgattttgttaaaggattgggaagccatttgtttcacaggggccttttctagccccacccagtgaatcatggttggctttgactgatcgtaaaatgctttgaccaacaataaaacatttccttgccagtgatttgtcttggatgaacatgcccatgtatgtgaagagctcagatggggcatgcccttgagaaggtttcttgatcttcacagagctatagaaaagagaatgcttattttctttcttttggcaaagttgtgtggggagctgttgagtccaacatgtaacagtgagacgaggtggccagcttggccacctgtgggacaatgctgagggttgtggggggatccaagaggacttccctccccacttcccagtggccaactctgccactgacctgagttgttttccttccttgtgtggtagcatgggtgaaaccagagacgtgcttatttcagtccattgggggctcttgtgttactcgtaactgggcattcttgctgaaatgggtagtctgtatactatgtttatttaaatgtattttatttcttattattttaagagacagggtcttcttacgtcacccagactggatggcaggggcatgattatggttcaccatagccccgaactcctgagctcacgtgatcctcccacctttgcttctcaagttgctgggactgtaggtgggcagtgactaattgtttttcgcatttttttgtagagatggggtcttgctatgttgcctaggctgctctctcactcctggtctccagtgatcctccaccatggcctcccaaagcgctgggattagaggtgtgagccaacacccctctaatataaataaatcattttataaattatttataaaaatttatttttatgatttgatttatttatattccctttaaagtgtacaaataaaagagacataaatgtagaggtgatgatacaactttcagtgtacacagcaaacaggtggccaaggtaagcccagaaaccatttgccctacttctctgggcaaatggttgccagatacaacacaggatgcccagctaaatttgaatttcagagagtcaatgaatatttttccttagtatcagtatggcctaaatatttcatgaaggcctacttacaccagtcatttcagttgtttatctgaagtgcaaatttagctagactttctgtatttttatttgctaactgtggtaatcctattctgccaggactacatgctttttatcatttgtcttcctatttttggactcttatttgaaaatactaaatacccagccaccactaacttaagccaaagaagtttatttgtaagcttaatttctaggtgtaatttatatgcatatataaatacaagttatatatatatgcccatatataaaatgcatacataattatattgtaattatatgatgcaaaattgaatgtataggtttaaataatttataggcttatgtaactctgctctctgttatatttcttgccaagtggattttgctaagataattatcagcaatgttagacttatgtcctatcatctttgtgaactccagtgaaaagaaagctaccttttttccaagagttgaaagcaccaagattagatcctattggatggatttaagtcatatgttgattcctaaactaattactatgagcagaaagatgagatatactaattggctgaacctggtcatgtgaccacatttgaagatggaggataatgatacagcaaatcatatccaaaccaatggaaactaggagcggggagattccccgagataaaacccgaacgcttttacaaaatgaaagtggagtggcttctgggcaaccaataatgatgtccactttagtcactaggtatcagacacaatgctggtctgaagaatgtgatgcttgcaactgtccggcggggccttggacttgtctgaatcggtattttgctgaaagtgggtggagggaagtgaaggttctgcatcacaggcgatgcacctacagcaatcagatatttgtgaacaaggctgttttgttctgtgtcagaagttcagtggggttcagcttgttagtcaatagtgaaggaaataatggcagcccgttccagtctcgccgtgcctgtgaggcctcctttgatttttccctcgtaaagaatctcatttgatttttatataaaactcagatttgaattttattggagtacttatacatgattgcctttcagtgaaacttactgtcattttagccgtaatgttctagcaaatggagtggtgttttttagtttcttttaaattgtttcattaagcaaatatttattgaccactgcacatgagttaggcattgcggatgacagagaaaaagtcagacaaaagtccatgtcttggagagcttacctgaagacattttgctgtgtgtatgacagaagtaaacggtccaagtttctgcatttaaatattatgttctctacaattatattgctctgggaaactggggagagggcacgtctgggaatttgaattctaagagagaatagacaggcacctattaaaagtgaagttggttttctagctttttctgactaggtgaaatttctctgtcataggtttgttttttttttttgagacagtctctctctgttgcccaggctggagtacagtagtgcactctcggctcactgcaacctccacctcctgggttcaagcaattctcctgcctcagcctcccaaggagctgggattataggcaccgaccaccatgcccagctaattttttatttttattttttatttttgagatggagtctcattctgtcacctaggctggagttcattggcgtgatctcagctcactgcaacctctgcctcccaggttcaagcgactctcctgcctcggcctcccgagtagatgggtctatagacgcacaccaccacacccagctaatttttgtatttttagtagacacggggtttcaccatgttggccaagttggtcttgaactcctgacctcaggtgatctgcccgcctcggcctcccaaagtgctgggattacaggcgtgagccaccgcacacggcctctgtcataggtttttggggggagaagctcctttcttcttagtggttggaatagttgtgagcaaagaatgctcaaagatgggcattctttgaggacatttgtgttcaccagaggacagcaagtgcttgaaggcagaagccatccagttccagtgcacacagcacagggtctgccctaaatggagaacccaataaagacttgttgaatggaggaaagtttgccttcccctcctgcttttttcactctggccattgaccttcccacgtctcagacagatgaggaaatgtcatgttaatatcaagaagtatgtacagtgaatgtgctcttaacctcatttttctgcagcttcattctatgtttccttaaagatttcgcagggatgtgatttggttccacccattgcccacatgtacaaaaatgacagaagactgacttgaagtgggcatgcaaagtaacattgcttttccaaagtgccaagaggaggatattcggtattaaatcagtatctccttaaatttgtgctgctcttttcttttgccagccttaaggtgctttaataactgtgagacatagtagccaggtgcttcctaagggaacctgagacttacttaaacctcttcccaccacaggtcaatagaatatacctgtgattgttcttaccttcagtgaagatgcttatgccttattgaggcatttactgatacaaaaaaatgccaggccagtctgacatcttaacctaaatctacagggtttataaggtaatgtgtacctgcaggaatattttttcctaaccttaattaaatgcaaggggaacaattgtaataggagtgccattttagggaggaagtaggaggtctgatttatggctgtcaattgttgcctctgtttttttcttaatgtgtatatttgaggtgtatgcaacatgatattgtaggatatatatagatagtaaagtggttatgatagagaagcagattaagatatttatcatctcacaaactttttttctgtgacaaaagcagctaaaatatacttgtctaaaatagggaagtcaaccttgatgcttcacttcccttttgtatctggggcttgctcacctcttggcccctccagcaccatcaccctgggcaaacaccgtcatctttgagtcattaccaccagagcctcatacacagatcctgcatctagattctcctccatccagcccgagtcatgctttaaatgcacgcatcttctcctgtctgttcccagtggctttatcacacaatggttttgtgagaacaaagctggaggtcctcatccttgcttgcaaggctctgcataacctggtacctggcaccactcccatcttgcctcctgcaactgcagtcgttcctctaggagccatccttattccatcccgtcttgggcctttgcacttgctgatctctcttgatcctctcaagatcagctctgttgtcccatgaatgccttaatctcgagtgtcctttcctcagacagccttttctgagattgccctcatcgctctccgcacacgatcctgctttatcatatcatgactagaacattcgccccttgttcatttgtgttctatctctccttcttcctaccgacaatggaatgcgagctccatgagcacagtggtgtttcccagctttattctgcagccctgccccttgaacaggctttaataaatcattgttaaataaataaatggagaagtgatcactggctgggcacagtgactcatgcttgtcatcccagcacttggggaggccgaggcgggcagatcacttgaggtcaggagttggagaccagcctggccaacatggtgaaaccgtgtctgtactaaaaataccaaaattagcttggcatggtggtgcacgcctgtaatcccagctactcagggggctaaggcaggagaatcgcttgagcctgggaggcaaaggttgcagtgagcgaagattgtgccactgcactccagcctgggcgatagagtgagactctgtcttaaaaaaaaaaaaaaaaaggattgattagttcgtcagtaaattatcttactctctctccatcccattggctggggcagctgactaacaaaatagcccacacaagggaagcaggggttttgtcctgcagagaaaacctcatagaatttaacatccgcatccaaacataaacactcaggaaatatgtctggaaaggaattgcatggcatctgcttccttccatggtgactttcaaatgacaaatgcccaacatcatttagggtggtagagcccctttgaaagagctggagctgattgcttctatcatgcccagaaaaagtcattgtcatctacacacacctggcttacatttggagaaaatgagcttctggtttctgtcttgctccaagattgaaatttccgtgctttgtgttactattaccaacagatacttttcttttgtgaagcgtctagccagctccctaatcactgggaacaaactttgagtaggttgaaccaaaggaggtgtcagagtacatgctttccagccaaataaaccttcagaaactgcaggggctggaggccctctcagtccttcacagccaactaagggtacttatttttgaaagttggactttttttcttagttattaaccagcattagctgcaaaagcattataggaaagaaaacgccttttctatgaaggtcagattcacacaatgcagatttccaaagaacaggatttctgtatttttaattgtttggttttggagactgggcgtcactctgtcacccaggctggagtgcagtggtgtcatcttggctcactgcaacttccgccttccaggttcaagcaattcacctgtgtcagcctccctagtagctgggattacaggcacaccactacatccatgtaattcttgtatttttagtagagacggggtttcaccatgttggcaggccagtctcaaactcctggccttatgtgatccacctgcttccgccttccaaactgctgggattactgtcgtgagccactgcacctggcccagatttctgtattttaacaggaagtgccaggcatgcttatggcttgatttttaagtgggtggtgcatctatataaaatgtgacaactattatctgtttaaggaacgaaatgcagggccagtgaaacatagatgactctcagtgaaatactgcagaaggtggttcttccttcacccaacaacagtggtaacagtgtttccaaggaaagaacaactcaagggagacatttaacccccaaagaaagttcataatgttatatgttacaagatgttggtaaaccacacatggaggggaatgggcatacaatgtgcttttgcctttgtgtgtgcgtgtgtttgagatggagtcttgctctgtcacccaggctaaactgtagtgacatgatctcggctcactgcagcctccacctcccaggttcaagcaattctcctgcttcacccaaccgagtagctgggactacaggcgtgcaccaccatgccaggctaatttttgtatttttagtagagacgaggttttgccatgttggtcaggctggtctcgaactcctgacctcaggtgatccacctgcctcaccttcccaaagtgctggggttgcatgtgccaaccactgtgcctatcccacaacgtgcttttgagcaacagcaataactccagacaaaatgagacccagagaaggttaattgtgaatcaccctttagacacagcactgaaggaagggttgtggtgtaagtagatacctagaatgggatgcatattgcctgaaaagataatttctggaaatgatgagactgggataaggccaaggggactcacctggccaaaatacaaatagagtgtttcatacgttacttttgcggggaggtaaagaccagagaatgagtgtcaaggcacttattttttgagaaatgatgaaagatgaacagcttttgggagcatgttaaaacagatttcatctgggaatttcattttgcacaaaggaatcctgtttgagcataagcgattggtaagttcattgttgttatagcccttggttatgctaaatacgttagtagctgaaagtttccaggacttgacaaatcagataaatcatggagtttttcttttctagtttttacctgattttggatgttaatttgttgttcattgacagtgggattttcatgcaaatgttgggtgttctgtaagcctgagaagtctcttggtgtcttagcctcaagatagcagagactttactggttattgttatttgttctttccaaaatgtttccgcagatcatatttttaaataaattgtaaaaccagtgatttgtaaaaatgccaggtcagtctgacactgcaacctaaatcttcagtatttataaggtgatgtgtacctataggaatattttttttgcccaatcttaattaaatgcaaggggaacaattagaaaggcccatatagggaggaaataagaggtccaattcttggttgtcagacgttgcctctgtgttttcttattgagtatatttgaggtttacaatgtgatgttatgggatacatatagtaaggtggttataatagagacacagattaacatattgtcacagagttacatttttgtgacgagagtagttgaaatcttcttatttaacaaaaattgctgatagaattttattaactttagtcctcacgctgtactcaatgttgcctcttttgttgtgttttatattctgtgaccatacgttttgtaacattaatcatcatccaaagactacactgcagaaggaattgtttacttggacattagtctacatatgcaaaatcaggcagatatttgtacttctgtatctttgaattatatgtaatgtcaattgctagatttttaaaaatataagcctgataatactataaataattataaattaaactacatttctgaaagctaactcttcaagtgataggattgttctttgcatacctatttgtatcctgaggaatcttgcatttccaaaatatatatatattagttagaagtgatgttttccacagagttcttttttgcattgttatattgatttttttttttttttgagatgtagtcttgtttcattgcccaggatggagtgcagtggtgctatctcggcccactgcaacctctgcctctcagattcaagcgattctcatgcctcagcctcccaagtagctgggactataggtgtgaaccaccacacctggtaaatttttgttttgttttgtttttttttagtagaaatggagttttgctatttggccgggctggtctcgaatttctgacctctggtgatccaccccccttggccttccaaagtgctggtgtgacccaccgtgcccagcctatatggaaatattttaattgcctgtaaacacactcagtggagctcgttacaagaagactgtcgatgtacttgaaaagtttacttctgcataatgctaaataccatgtcagaaatcacagaatcctacgaagttgaatttttcattaaaggatcataagtaaagtttggggggaaagtgtgcagttcaatagatctcaatatgaaatggcatattattgttatttatatgtatatttaatattatataaaacacttttgttttaacttaagcatttggattctgattctttgaggcgtgattatggttttgtcattcacagcttagctatgtcatctcagataaattaatgaaatgtccaagcctcagctttggcagtttttaagtgggagtaatagtattaatacccacctgacaagattaccctgtagacggaacaagataatgtaaaatgatgaatgaaaggctttacatacagcaagtgcttaataaatgacagctcattatcattattgtttttatatttacttttttttggttgaaaatattaatcttctgaactacccttaccagtgccaaaacaaccgtaaagaaacaatcgtgcagtcctgttatccacgtggcatgagttacagggttcattatactgaagacaataaaaaccaaaaagaaagcagcacctaggaaggagctatttgcagaagtctcactcaaaagagttcaaaatgagagttccaaacctaataaagataacacgtttgccctctggtggacattcattttgagttagaattttctctgctaagactagagatttttcaacctccctaaaatgtcagggtgttgtagctggagtagcaaacagttctgcctgcttcgtttgaattttgtctgataaatgtgcaggtgaacgtctaaacgcacaacatgcatgggcaaatgaaatgttttatggctacagcgtaatgctctcctcatttttgttcagctccttcaggagttaacaattgctaagggttatttacaagaaatctgagctgtctgatcactcaactgtggaaggtaaatgagatttttaaggtgaagggaaaaggagaggcaaatggtaaaatgggccaatgcatgaaaaagagggagacgtcaaacttaggtactggaattgccgggatgttgtcatcaacgatttgatttgatgggaaagggatgcttaatgtttcttctgtgaggtgtgtgcctgtaccacacacatgtacacatacagtggagtggaaagtattcctgcaaagggccgcaattctcagagtgtagtcttttctcttcctactcgaattggtaaaaataaataatcaagactgttttggtggcttctggttccccaagtagaaagcatcttagttggcaattcagtcactgaccttgaaataggacaccagacctattgctaaaacgtcttccacctcacaggccttccctgcctgctgtcctggtgaacttgttgactctatgcacataaggactctctggggtccaaatgacggggaccaagctcgcacacatcattcagcgaataggctggctcagctaaccaaaggttccatgggctcatctagcttaaggtggctgtattccttggggcggggttgggggggaatgaaaataaggtcatcaaggtgtctctctctttctctctgactctctatttctctctccttctccctccttccatcacatatctctgttttctttttccatgttggtttcattctcaggtagacagtcttcgtgtggtgacaagggtgacctgagactccaaacctctgtcttcatcactgcctttgttttcaggaaaaggagagactcttactctgagcataacgccggtccctgaataaggacagcatctctctgtctgtatcataagcccactttcacaccagttacctctttggtgggagtgggttactctgaagagcctcagtcatgtgcccagccccgtggggtttttgttttgttttgttttttttgagatggagtctcactctgttgcccaggatggagtgcagtgcctccatttcggctcactgcaacctccacctcccgggttcaagcaattcttccgcctcagcctcccaagtagctgggactacaggcctgtaccaccacacctagctaattttttttatttttaatagagtcggggtttcactatattggctaggctggtctcaaactcctgacctcatgttctgcctgcctcagcctcccaaagtactgggattacaggcataagccatcctgccctgccttgcctgtgttttgggagtcaaggcgagatgatgagaagggagggtatttgctgacgaatagtggcgttgtgttgctaaaagaagggcaaagggtgttggatgggaagagccgaaacacgcatgcgtgatgttcagggcccttagtccttgttctttttgtctctgcaagtttgccgaagttgctctttgataatctttcttacctttccaaattgcacctaccctttgacgtatagctcaagttgtactttctctgtggactttttctcccagcctggcttcagcttgccttcgattttaagctgagagcacttacctggtgtacccactggctgtttaagtgctaacggtagctcctgctgttattgttatctcttattccagccttctaacattttttccactgtttcattttgttttttgtttaacggttttattactctttgttttggggactgacaaatttttggatgcccatcttatctaacacagtcagtactgcctcttttgatgatagtgagataggaatttcaggagaccaaaagaaagagcttgctcaaatattataacttgccctttagtcacttttaaaatgcaatgtccaaccaaccttttagttcttaatggaactcttgtcagcaatctgcttgaaggtcagcctcatcattcttggatgtggtcctggggcctcagagtgggcattgttcccttagggagtggaggccagaagatgtagggtgccccatagcaggcatctaaggctttgggtgctccaagcactgctccgggatggggtcaaggaggagaagttgcttgtccttttaaaaatttttgcctatgctgcaaagattatgggtcaaagtgaaggtcatttataaactccacccatggcaaaatccaattataaactttaaccttagtgaaatgtcattagagcttggcttggctttatttgggatggagactgacagttttgtctgtgatatattcagggagacatatctattaaagctagtctaacaatgggggcacacgcagatttgcattttaattcgttttccctcagtgctgatatgcggcttatctttcaagaacaggctcacatcaaccctgatatacgttgcttaagaataatgctcataatctattagtttaatctgttcacatgagaaagaaagaagaaatcgtgcatggtgcggagggtttcaggccccagtgggcgattttttggaggatttcccattacaactgttttcaacttgtgcttgttttcctttctctagcttaagtatgaacagcttaaggagaggtcatgtcttccttctacgtagagccaggcaagctcacattacagtcaggctcccaaagatgttggttatatgcagacttctgaacttgggttccagtttcatgatctgcaatgagcctatagcaattcaaccttgaaaatgggttttgatcattaccgattatgtataaaaatgacccatcagaggacccgtcagataacagataatcaatatttttatttttctggaagtaagatcgctgctaagacctttagaactttctgatacctgcaatactttgtgctttttctctcacctctgccactcctgggggagggaaggggtcttttctttgcaaagtgtgtttaatattggaaggagttgtgtttaactctaagagttctatctcactttgcccagtgttctgcattttcactggttctttcacttttttactttttttttttttaaacactctcccagtggattctctctggggtccagtgaccttgatgtttttcgtccagggaagatggctgaggcatcccagcagggagtcaggagtaggaagaaggtctctgtaacagagaagttttggaattgccgtggggtgctacagcatgaatttagagttgggcaaaagtgcctgaaaagcaggccttctcatttcataatgagcgtcatataaaccatgtttatcacttcgtttagccacattcggatttgtagaaaaatggatagaagggatgactccaggcagattagcaaggggattgcattgatcttggggtcattggagtaaagcaaaacatgatcactgacctttagctctagggtcattgacttggtagatggaacttgaaagcaagagtagaactcggcaaatgtggaagttaaagataaaatgtggcctggagagtctaatggaccactaaggattaatgcactttgttatcacgttggggaaagacgagaaggagtggagagaaaagaaaatttcgggatttgaattcttatacatggaagagttcagagaggttatgtccctagaaggctgagatagagaaggaggtttctgatgaaaaaaaaagcttcagccaaattaaatttaaaggagttaattgaacaatgaacgattcctgaatcaggcagcccccagaatcagggcagattcagagagactccagcacagccacgtggtggaagatgtatagacaaaaaaagggaaatgaggtacagaaattagaagtgaggtacagaactgagctagattggttacagctccgcgtttgcctaatttgaacatagtttcaacactcagcagtgtatgagtgattgaggtgcagccactaggattggccaagactcagttgttgttacaggcacatgctcctaagttaggttttcttatttatttatttaggtggagtctccctctatcacccaggctggagtgcagtggtgcaatctcagctcactgcaacctctgccacctgggttcaagtgattctctggcctcagcctcccaagtagctgggattacaggcatgcgccaccacacctgactagtttttgtatttttttttagtagatagggtgttttaccatgttggccaggctggtctcaaatgcctgaccttaagcgatccacccacttcggcctcccaaagtgctagattacaggcatgatcttatcgacctattaagttaggttgcggtttgtccacaaggactcaaatatagaagtggggagtccttctcaggccacatttagtttgctttaacacagctgaattatatgtgtgaggctatggcatgaggaagggtatcatgaagaggttgaagtccatgaggtaatgagagactatgaaagccgtgttcatgtccagtatttgccatttgcttgtttgttttcttacccgctgggttccactgtagtgttaagtcctacgagaccctggtctgtcctgctctctgctctttttccaatgcctttgacagttcttagcatgtaatcaatctgcagtaaacagctgctgaatgagggaattaataaagtcaccaaggaattgtgggctcctcttctgctctgagccccgtggatgcattgttatgcgtaataagtgtgaaatgagcatttgttgattgtattccatgtcaaagcaaaaaataaaaataaaataaatgtcagaatacactcatggtgctattaattatgatgtagagctttttttcaaacttttattttaggctcaggggtgcataagcagtttttttatttaggtaaacccgtgtcacgggggtttgttgtacaaattatttcatcacccaagtactaagcttagtacccaatagctatttttctgcttctctccctcctcccaccctctatcctcaagcaggccccactgtctcttgtttccttatctgtgtccctgtgttctctttagtaccgtttattagtgagaacatgcggtatttggttttctgttcctgccttagtttgctaaatataatggcctccagctccatccaggtctctgcaaaggacatgatgtctttcttttttgtagttgcatagtattccatggtatatatgtaccacattttctgtatcttgtctgtgattgatgggcatttaggttgatgccatgtctttgctattgtgaatagtgctgcagtgaacatttgcatgcatgtgtctttatgatagaatgatttaaattcttctgggtatatacccagtgatgggatcgctagatcaaatggtagttctgtttttaggtagagcttgtcaggatctcttcttccctctctccttctttgtctatatatgcaggtataacaggtaaaacatatgtgggatgattctacatattttgtaaatattttccatgtcaacatatcaatctataacaccaatttcaaggttttgtagtccagccgcaccacaacaggttttcatgcatcccctattgttgagcatttaggttgttctcaattctttccactttcaatgcataaggagttcaagactcgatttagagaatgcctcaaaggtagcctttggccaaatctagaactagagctcaacagtgccacagcctaaaagatgaaatttagacacattcctggagtttggtgggatatttggctcattggcttgttggaccagcagttagatttggagtggttctgcaaatgtcttgccatgaacatatgatataatgcttagagggttaaaaagcatacctggattttcaagggttaaaagtagacctggattttaggtcccagcctggcctagagcataagtgacttgtggacatcctgaaaaagaaacccattctttggaatagcagaaaagcggcatacatcttcagatgaatagtaagagtgattgtgaaccaaagggtctgggtgacttggctgtttttatcttatttttattttatttatttatttatttattcttttaagacagagtctcgctctgtcacccaggttggagtgcagtggcatgatttccgctcactgtgacctctgcctcctgggttcaagtgattgtcctgcctcagcctcctgagtagctgggattacaggtgcatgcctccacgcttgggtaattttttgtatttttagtagagatggggtttcactgtgttaggcaggatagtctcgatctcctgacctcatgatatgcctgcctctgcctcccaaagtgctggtattacaggcatgagccaccgagcccagctagctgtttttttatcattggtcaaggatgtcacactgcatggtggtggacaaaccagtgctgagaatgaggccttgcagccaagtgtgtcactttgcagcctgtgagctaagatgtcacttgcaatcgtgtagggagagtgggccccggacagcggggagatacaacgtcctcatcttctgcaagttgctctggtgggaaagaagggaaagcaggaatgagtaagggaaacagaggaaactgagctctgaagcccaacctctgcttcatctctcgtttacagttccatccctgtgagcaaacccttggtgtctggagagcagaaccatcacttcccatcttccttggctgtcaaccaaaaattgcccctgtggccccctgtagtgcccctcaacttcatgtcctacagtagaaagtcctctgtaagctcttcaggatgcacagtctagaataatggatgtgatgcagcctcagtggtggacttcctgagttcaagttctgtccctctggattattcaatgtagaaacttcatcacattgtttaaccttcctagatgtgtttgctattcttcacaatcaggatcacacatatagagtacatcacaaacaatgtaagctgcaggacagaagggttttgtgttttccaatgctgcatttatttttttattgctgctataacagattactgcagacttggtggatacaacaacacagatttattcttttacagtttgagtggtcagaactcgacactagtctcacagtgcgggcagagctgcactcctttctggaggctgatgtggagaatcttagccttttccagcttcctgaggcatcctgcagaccttagctcatggcccctttctccatcttcgaagccagggatgtagcccttctccatgcatttctttgatagtaacagcaagaaaaggttctcagattttaaggactgatacgatgatattaggcccacctggataattaagactaatttttcccatttcaagatccttaacttagtctcatctgcaaagtccctttgccatgtacggtaacatagtcacaggttcccaggattacagcggcgtggacacttctgaggggtggggtaggcattgttctgtgtactatgactgccaacacccagaatagtgcttgacaggaaaacagatctcaaatatttgccataggaattaacggtgattattgaagagatccaatgtctttaaagtgcctagtgggatacctggcacatgggtgagaccttggttagtgttacgtgttatttgcagtcatatgcatcactcaaaggaaaatttacaaacacacatgtgtgcatgtgcacacatagacacacacacactccactcaccagtggatattgtttctagatgcttactccctgtctacccaaatcgattgttcctgctgcaggggcaggagacaaagctattgaattgtatggagtggacactgaccactccctttttttttttttttttttttttgagatagagtctcattctgtcactcaggctggagtgcagtggcacaatgtcagctcactgcaacctctgcctctcgggttcaagtgattctcccgcctgaacctccagagtagctggggctataggcgtatggcaccatgcccagctaatttttatattttcagtagagatgggtttttgccatgttggccaggctggtcttgaactcctggcctgaagtgatctgcctgccttggcctcccaaagtgctgttttgtttgtttgtttgtttgttttttttactaattatgagtcagaggaaagagctgtcccttttgaagtcattaaagttacagagtccttcacagtgatctcgaaaccttggagaactttgaaaataacccaaattctcaactctgtagtagcagactcccaagacactgcatatacttttttattcccttgagttcatcaccctgtggttgagaggcaacttaacaggttactggagctgtctgacttggtttgcacttctatgagtcggcgtcatgttgggtacactttgcctttattcctcgaatttgctggttttttggtttcagactgagtggtggagaggaggcaagatcaatacctcattgtcctcactgttgcgctgtcatcagaaagcaaagtgtgtgtctcctgttgagaatacaaaagttagggccgggcacggtggctcatgcctgtcatctgaacactttgggaggccaaggagggcagatcacctgaggccaggagttcaagactagcctggccaacatggcaaaaccccgtctttactaaaaatacaaaagttagctgggcatggaggtgcgtgcctgtagtcccaactattggggaggctgaggcacaagagtcgcttgaacccaggaggtggaggcttcagtgagctgtgatcatgccactgcactccagcctgggtgacagagtgagagcctatctccaaaaaataaaaataaaaataaaaaaataaagaaaagaaaaatataaaagttaggatatcagcacaagaacttcagtgttgtagatctgctctgattcttcattcttttcaagacatgatttggatgttctgcacctacgtctcatgctggatggtgaacttcagtgcatatgctaggatttgtgctccttttgcatcctgtggctaaaagttcaggctgatcagctaagctttctctatgtgccaatctaaggatgcctttgagaatagttgggaggtcatttgacaccctttccaatagtctactgcttaaaaggaaggctctggtggcagatggccagagctaagctcctgtatccactgctcactagctgtgtgaccttgagcaaggtgcttaagtcatctctcttcctcagtttctttaaccatagtgtggtaatagaaaccatacgtatctcccagagttgttataaagataaaatgagttatcacagtgtaagcacttagaactatatctcatatacatagtaaatgcttgttaaaggcttactgtgagtccgtgactacagcttatattcatattcataagcaaatagcaaagcaatagaacctgactatgaaaaaaggtagccatgagggaaagaaaaaggatggtctcctttggataaacattttccgtaatacgtccctaggaacacattgtccacaaaagatgttaataggagtgctgagttacagggtaccacagtcataaatatttgggaaatttcttctcctggagatttatgatgcgcattagtatgttaacattacacgttctgctagagctcagagtagagacactaattttggctttatttaatccagttggtcccagatgtgtttgaccacccggtttttctgtaggtcgggggggtgggggcgagaggatgggcttagaggtggttgtaatggttgcgcttttgttgtgcatagcacctagtaatagctgtaggaactagtgtttcctctcaagggcacgctgtaggatagtactagaatttaaagtgcatatagggatctgagtaaaatatagatttggattcagtctggcatggggcctgagatcctggatttctaagtggttccccattggtgccgctgctgctggttgtactggtctgtggactgcactttgagtagccagactttcgggagcagtctcttggtgataagaagaggacccacacggggacaatcagaaatgttagcaattgtgcagtaaggagagaggagagcctgaggcagaggtttgcaaccttgactgcctgttagaagcacctgggagaattcagaaagctgctgtttggactccacccccagatatgttaacttcaaaggtttggagatgagtcctaggtattggtatttctttttcccacaagctttccaggggaggctaatggaccaccaggctgcaaaactattggtttcatagtgatgggcttaatttcttaagtcagagagcctgtttctaatcccagccctaaattactacacatcattagtaatttatttattttttatttgagacctagtcttgctctgtcacccacgttggagtgcagtggtgtgatcttggctcacttgcaacctcggcctccccagttcaagtaattctcctgcctcagcctcccgagtagctgggattacaggtgcccaccgccatgcctgaccaaatttttttttttttttttttttttttagtagatatggggtttcgccatgttggccaggctggtctcaaactcctgacctcaggtcatccgcccgcctcagcctcccaaagtgctgggattacaggcatgagctactgtgcccagcctcaggattgaggaatttagttaaagttgctgtgcctcctttcttctcattgtaagaggaggcaatcagggtacttaaacttcaaagagtcttgatggagatttgatgataccatgtttgcatcccaaaagactggtgtctaacacatggtaagggtgcagtaaatgtcagttgtaataacaattattgttatgagtattattgttattatttgctaacaaccattcttaggtcatttttttttttcttttccaatctgaccaagatattgtattggttacaagctaaaaccagataaacatgtatttaattttcttaataagtggagaattgtgttaaatgtcttttgggtacatgtgtccttactgggggagtgcttgcttctagcctaagttgcctccagcaagcattcatggaggctgtgattgccgtgagaacaggtcaaaaactgtttttgtttactgtgacaaccccagtgcctggacatagtggttcaacctgtcttggttgttggcgttgaataaatggatggtaaccattccaagtggagatatgtcagctcctgtctgcatccattcatttatttcagcaactgaaaacaacgtaatagtcatttaaaaaactgaggaataccatattttggattatttgttgttccggtgattttgccaagtgtggatttcctttgctaattatggaagtagacaaccaaatctcatttcttgtttgttttttttttttttttcctttctagaagcagctgtgttccttgccctctgccaccatcccactcatacactgtctaaaataaatagctttttctttttctgccctgtcttgtttctttctccctttgccctccacccaatttcctcttcccagtgaagtctgtaataatgtatcagtttacttaatgcaattcccagccctagctttcattgatttttttcttatttgactattggcttatgatttgtggggtagaggaggtggtgtgcatatcatgtgaatggaaaggcttaataattttcatactgtttcataacaaatatatattgtattcaggttcagtgactgcctttatagaatcatgtcagaaagtggatttctatcctgtttcatcttctatgaaaaacggaaaacaagaccttttcccctcactgtcatcccagcaagatataaagatgctcaaatgaacatttgtggaaggacttgacaggtgcccttggaaaggaagcaggattttactcactgatattttgaatatcatgagagttagaattacgaatgagtacacccaagcacgcagtcggttaaggagactttcatactcattgtggacactgctcacaggcaaaattgattgtgcggctccagttgctagagccacggggatttgagaccacagctacatccatctaattcaggaagaacttgaaatagctcctgcattttcagtgggggtaaaaaaaaaaaaaaagagccttttcacatttatcctgaagatggagccatttaacattttggatactttctgatttttaaatttataactttaaattgactttgttttgagacattagtgtttcaggattttatttttccctaaaatatgattgcttcctaaccaacagaaggaagagtagtgtgaatatttggttatggtcatggacacctggggaccagcctgtgtccttgcccatatttccaaaggtcactcttttttttttttttttttttttttttggagacagagtgttgctctattccccaggctggagtacagtggtgagatctcggttcactgcaacctctgtctcccaggttcaagtgattctcctgcctcagcctcccaagtagctgggattacaggcacgcgccaccatgcctaactttttggtatttttagtatagatggggttttgccatgttgaccaggctggactcaaactcctgacctcgtgatctgcccacctcagcctcccaaagtgctgggataaggtcactctttcttgtttacctgtttctgcccatatctgtagactcagaaattatttactaagcatttctaaaatgtgtttagaattcccatcactgatggcttactatgaaggagagcatatttttaaagccatataaaagaaggaatgtgtttagttctgttactcttgtattaatcccttggttattgaatctagaatctttgagcccggatgatcctagagggtatctagtctaccttctcatctcgttcttcaagacttgtatttatgtagctagttgtcatggctggattaaaatatctgtgtttacttatgtaactctcaaaactcactttaattgatctttttagcaagggcctgtttttcacttgcaaatgaaggtgaagtaaatacagattggcattttctgtcctaaacagccaccagctcccatagctgaatactctcatataaggaagacaaaagcaacaacaaattaggggccaaaattccttacttagaagatgagttgtctcaattgggaaggatttaaaaaatatttgtataccactcaacaagccatctggagaccatcatgggctgaactcaggtgagacatcttgataaggtactggaagaacagctgtcttaccacagggagggtggatgtggaaagaaatctagaaacccaaatataacaaggagcccttaaagcagttgtgggcaactcctgcatgcttgagatgagcagtggagacgacagtggggctgtcttctccctttaactatccaacgccgagggtcccaggctctgtgatgatgatgtaggcaatttcttaagaacaagtattgtttttggtagctttactttctagaaggctggatctcagttctctctcccatatcacctgtgtccgcaggtggggagattgatgtttagagctaggtttatctgtataaaggaataattctgatcgtagaaaaactcgaagtactggagacctgaccccatgttgggactctctgatgccttgaacatagatcatcttctgggggctgggctgtagcatcaccctcatctcacagtctgaagtcctggcttggagccctactgggctcagagactgtggtccgcagcccactagtgttatcaatcccatcagcatggatgcctacagcaacaagaaccagaacacccaacagcacctgctgctgcctctccttctcctcttctttccccaccctttcctattattattgttgttattgttaatatttatacatctattggtataaggaaaattaggccaaaacttagtgtatcaagatcaaaacacattatctttcatagtttctgtgggttgagaatttgggagcagcgtagttgggtttcaccatttagtgtgataccagctgtagtattttgtagatgccctttataaagttaaggaagttctttctattcctcggttgtgagggtgtattttgtcatgaaagggtcttgacttttgtcaaattctttttctgcatctgttgagatgatcatatggtgtatgtcagggtttaaagttttttccatgtgtggctgcatttggtttgccagtatcttcttgaagatgtttgcatctatatttataaaatatgtagatctgcagtattctttccttttgattttttgtctggttttgatatgaggataacagtagtctcagatttcttcctcttctattcttttggaaggtatttcgaggtgttagtaataattcttctttgaaattttggtaaaattcaccagtagaggcactggggtctgggtttttctttatgtgaagttttttttgcctactaattcattctctttgcttggtataggcttattcagattttctatttcctcttgaaattttggtagtttgtgtctttccagaaatatttttttcattttatctaggttatctattatttttggcctaaaattgtccataagatacccttataatcctttctattctataaaattggtagtaatgtcccctctttaatttctgattttggtaatttgagttttctttttttttttcttggtcattctcgtctctctgtttcatttttgttgttattgtcattcttcttttttcttttttgagatggagtttcgctttgtcacccaggctggagtgcagtgttacgatctcggctcactgcaatctccacctcctgggttcaagtgattctcctgcctcagcctcctgagtagctgggattacaggcacccgccaccacacccagctaatttttgtgtttttagtagagatggggtttcaccgggttggccaggctggtctcgaactcctgacctcaagtaatctacctgcctcggcctcccaacatgctgggattacaggtgtgagccactgcacctggcctcttttgtttttaatcttcatttctgaaagtttttatattatctatatagcttaaagaccagccaaaaatcagctaagattgtgttcagacaccttgagcactaagaagtctcctgtcctctactgatgggtttgtgtgtatgtggaggtgtgcattgaaatttcaggccattttcaaatctttccaagtatttagactctactggttcctttggtatcacctctgcatctgcacactgcttcaggattaatctgaaatgtatgggctggtaaagtcattggctctctccagttttccatcactgagaatataatcacttctaccaataatgctgctggatatggtcacggccttctacctgaaaacacatgagctccttttggaccatggcaactgagctgccagtactcatagcctactctacccaggcagagcctttgtgttaactagggatgaagccctcatctagaataccaaagagtcccactgttcttgcctaaactccagtcgatttttggtgaatacttgttacattattggaattctttggttgatttttagagtgctgaaattttgggggggtcagttttgtccacaaggattattgctatttggagagaggaatgtctgacttcctcactcagccatagctggtagtcccaaatatttttcacgtgaacttgcatcctattagccaggaaagggcacaacgcattgggaaaacttgttttaaaacagtaaccgtagtctattcctgtggtgggggggaggagggtccccacatattcacattagaagtcttacgtgaagccattggggattttcctcaaactttacccacagcactatggttctacaggataagatcctgtcatctattagtgggtatggagaacattatgtgcatgcagttgacccacaaaatctcagtgatgccgtataattaagatgtatttcttcctttcatcatggtctgatgtgaattgggtctctctctggttgtaggttccttccagccgtggcaatatcatcttgcaacattttggctcagtttccatcgatggggatgccgagatcattggcaattacggaggatgtttccagaaagcattttatatcatttctgatcatactgtattagccagagttcagtcacatggtcccactaaaatacaaggaagactgggaaatgtagtattcctgtgtgcccagggaaaatacaaaagcaaacatttggtgaatatagtgcattctgtttgccactcattctttggagatcctatcacattattaagcttattctctgggaaagaaaattgggatgcagaaatcgtgaatgacttaagatgtgttgttttaagtaagttactggaagattaggaactggaaatatttattggcttctaatttagttttttcccccaattttactctgttctctctcactttcataaagtgttgcttcttaattgacataaataatacgacctaccacagccactttagaataagaatcattcctaattccaccagtttaagattaatgtatgcatgttttctttacagatgtacgtttatataatcaaacagctaatatgcatttgttttttattgtgtttgccaacacgcacatagtcttcatatgtctacattcttattgtaattactatttttattgccacataactttgtattgaattggtctaatatttacttaccccttcctcctattattagacatatagttgtttcaattcattttaacctatataacacattgtgattttaaatatgttttaaaatatatttttgcaacaaatgctgattaaattgcatattctgaccacctgtggacatttaggaacgctgtagttaaatagggtacctctaacttacatcctttatgctcttactgaaacatatgtgaatatagtatagtactatttttacataattcttttttaatgaaaatatttagcttgtgaagaatagaacacattctcaagagttgaatgaacctgttaatgtacttttatcagctttgtaatgcagtatttcattaaaatgtgtttatactaatttagtagtatggggcgaaggatgaaaagaaacccagaaatgtcagatcatatacattaattcactgacaaatgtttttgagtgtttactaagttccaggcagtcttttagaaactaaatatatagcatgaagaaaaatctttctctcaggaaatttgtgttctattgggtgtcaggtggcatgtgaggatacaatgtttgtattaaaaacaatgtattaatcgccatgaagaagaataataaaggtaaggagggctgggttcaatggcctacacctgtaatcccagcactttgggaggccaaggcgggcagatcaggaggtcaggagatcgagaccatcctgggtaacaaggtgaaaccctgtctctactaaaaatacaaaaaattagccaggtgcggtgccatactcctgtaatcccagctactctggaggctgaggcaggataatagcttgaactcgggaggtggaggttgcagtgagccgagatcgcgccattgtgctccagtctgggtgacagagcaaggctccatctaaaaaaattaaataaataaataaataaataaataaataaataaataaatgtaaggagaataggatatgttcgattgggtaagggatgctgttatatatgagagaggggtctgggaatacatctctgatgtgtaacatttgtgcagaaacatggaggtggtgaggaaaagattcacgtggatgtctagaagatcagaaagaaggaacggccggtgtaaagacacctggctgcagacttcttgtcatatccacagcaaggagtttagtgtggctggagcctggggtaggggagaaaaagagacaagagtggtaccacatgaggtgagtgttagctggggtagaagctaggaggggactggagcatgtagggctttgaaggtcatagtatggacctgggatttagctttgagcaggaaaagaagccattggaggatgtattagtccattttcacactgctggtaaagacatacctgagagtgggtcatttataaagaaaaaagtggtttaatggacttccagttccacatggctggggagaccgcacaatcgtgccagaaggcaaaaggcatgttttacatggtggcaggcaagagaaagagacaaaggaaagggatttccccttataaaaccatcctatctcatgagagttattcactaccatgaaaacagtatgggggaaactgcccccatgattcagttacctcccatccggcttctcccataacatatgggaattatgggaactacagttcaagatgagatttgggtggggacacagccaaaccatatcagaggatgttgagcacatgagcaacatgacatcatgcccatttaaaataaatactctggctgctgggtggagaataggtgtgggaaaggatggaaccagggaatccagaaggagacattacactcatgggggtgagaagtcgtggtaaatggaacagaacttgcaggtgtgagaagtggtcagagtttggatatatttccaaagcaaagactatatgatcgtatgcttaggtaatggtttgaacgtgagatgtgaaagagagagaggggtcagtgtttactatgggaatttttattattcttattattttagacagagtctcgctcttttgcccaggctggagtgcagtggtgcgatctcagttcactgcaacctccgcctcccgggttcaagcaattctcctgcctcaccgtctcgagtagctgggattacaggtggctgccaccatgcctggctcattttttttttttttgtatttttagtagagacggggtttcgccatgttggccaggatggccttgatctcttgacctcgtgatccacccgcctcagccttccaaagtgctgggattataggcatgagccaccgcttctggtctactacaggaatttaagcttgagcattcagaaaattgaagtgctagttccaagatggattgcaagagaagcagctgttcagggaaagagagagagaagaaggaagaggaattgcaggtttacacttgtgtgaattcggcatgaggtgcccattggatttccaaggagagatgtcaaggagacagctctgtgcgtctgtagaacaaggaagaggtttgatatggagatatagatttaggactttccttcttatggatggcattagacacctttagacaggaccagctcacatccttcaccatgtgcacaggctctaatatattcaacatttaaaaaaattaccctgtgactctatttcctctccatctgtcactctctttctctgatttcctttacaaaactctgaaataaaacttgtctatatttgctataatttcttttccttccattctctcttgaattcattccaacaaggcttccctcctgcccaccttcgaggtgatcttatcctgtttcaaggcgttcaataccgacaataagctgattatctccattttacaatgaagaaaccgaagttcagaggggttaaagccacttgagtattcaatagcagaactcaaaccagagccttgctttcctttcctatccccagcctgtctctttccactgcatccttgttcacgatgaaatcgtgtttgcaaacaagggcttggaaggtgatcagcgtgggtttaagtaccaatgtacacagagcatttaaaaaattcctcatagctaaatagaatataatatttcacccctatacacttgtgggtctaaattgttaatgtctgttttcttacaagaaataaaacttggagaaagactgtggacttgttccttaaaacactataatttcatgtaaatcattaaattttttaaaagtctgtgataatgacatggttgatgagcgtgagagtaggagacaggaggagagttggatcttctttccttgacatcctaaagaagaaggaagacaggaacctttcagagcatagcaacagggtgtgttaccctccttagagctaaggacaggcagacccacatcttctttcttacctaaatagctatgacttaaagtcaatcttgtactgctgtggcattattatttctctattctccttggatgtgtgtttcttgcaacggaagtaggaggattgtccagaggatttgaaaaatatttttttctgacatgattatatctgtatatgaattcatttttttggctgtgatctgtaaactcaacaaaacaatgccaaaaaaatcaaatgtggtgaagtgctttttttaactcctgggttcgtcatcatcagtctaaaactcagtcatttatagactgattcatgaagaaatatacaactgatgactctgggttagagtgttgttccaggggatgatttttctgtgcaagggaatttggagtgagtttgaagaaggagaggttatgaattagtaaagataaatagagaggatcatctgcatatggggaatgttccatgccgaggtgtgagcacaagaatgaatacattgttcataagggtctgtaaagatacttgcttggttagagagtagactgcagaaacagataactaagaatggagatggatatagtgaggagaggggcggggaggagtgtgaggtcagggaaaagaactggacattgccctagcttcacgttgaaagcagagatagggagagtgtggcttggtgtggaccatgccataggctgtatttggatggattatgggttagtgtgaggaaagactgaagtcaggaaacaagatggaagctccatagcaatgggcatgtctggagatgacgttgaccttgcctctaggaggggagcagtgaacatggcaacattggtgccaatggggagtgaaaaggagatggaagaagaggtcaatcctccatgtgggcagtattgggcatagcagaatatgcagagaatgtagggtcacactggtgaacaaaggcccccgagttgggagaaatctaatcttcgctcaatactctcgtggttcaagatcctcacaagtcattggatgtttctgaagctccattgatctctttatttgggtatatttatctgtgtatctagtcagtgatactgttgaactgtaatgatttgatatccatttggcatgtttttgagcatcagttatcatggaccagtagaggggatgcaacactatatcagagagacacttttatcgtagatgtatagttagaaagttattgtcatgcttggccctatcatacaaagccctgatgctttcatgggggaaacaggaaccctttggatgacctgtatcaggtcatagaaagcattctgccttctagggaagtgagttgggatgacgatcgatgttttcttggagagatgctttggtctaagccatgagaggaggaaagagtagaggagggatattttaagctaaggtgataacagcatgcacaacacccctagatgtgacgaggctgagaaactagaggaagggtcagggcagagataacagggataaaagattgggaatttaggcggaagtcagacagctcagcattttctaagcttttctaatgatggggaatttaagaattactgtaaccaaaaataactagctctcacaagtattgtgtaaggtgtctctggaaaacagattggagaagacccagctggaaccaaggatatcagttaggagattttcatattaatccaggctggagatcaggatacaggtggttccagtgggaactgagcaagtaggtagttttaatcaaaatttagaaggaaaaatgcaccttacttggtaactgcttggatttgatggcaaagtgggatgtagagagtgggagacggaggggcaggctaggataacattaacaaacgtttgccagacacccagagcaaagtcagctttcctctctggctctgatacgaatgtgaccattgttaactgtttggcacatgtgttaaccttagaatgttaccagtgttaactgttttgcacatgtgcgtgcatatgtgtgcacatgaatgtgtgtatttaatctcaactattcttattttgccatgaaattatttaacacacatgtgctgtgtgtatgtatatgtgtatacactcatccctcagtgtccacgaaggatcctcactaataccaaaattctggctttgtgggatccacgtatacaaaaagttttccctctatatttgtaagttttgcatcccatgaaaactgtatcttctatgtatgctcagttggataaaaaatccatatataagtaagcctgttcagttcaaactggcgtgatccaagggtcaatagtttacgtctacccacacattaactagtggctgtttcaaggaggcagactgagtgatttattttcatgcttccttcaattttttctaagtttttaccatgagaaaaaaaaaaattttctccagaagaccaagaaacaattagagctttgagaagaaatttatctgctgttattgattttgttttagccaaaaaaaaaaaaaaaaaaaggctaaacataaaatacagtgttcgtaaacctggctggcaacctttctctgatgttattgtctatttcagacaacgcaaagaggtgtatgaaaccagaaaccttcagctatgaggaaaacaaaataacaatcaatatattttgtttctgcttacattttctgctaactccttgtttcccagctaccagagagctgtcaacttcaggaattaaattaaaaagtataaagctgtgaatgaaaaaatcttggaagtaatgagactacactgaatgaagtggaggcgaaaaaatggaacacagtaaatgggcacctgtatcagtgtcatctttaaatgcaaatgaaaatgtcccaaaccttcctaccgctgatactttgaagcacatacagttcatttttagccaggtgtatcagttttgcattgccaaaagtagtagtggactaaaacaccagtctgcttttcttttattaagagatctgtaataagagaggttgaaagaaattttgcagtgccaaatgagactccaagtgcagtgcaagatgaagctagtcaattctgaaatatttgaacatgtttatttatctaaccctctatgaacctgggcacagatgctaagtcttccatgttttatgtggtttcagatgacctctgaaaattacctgtgccattctaaaccaccaaatggttccattttccatctgttgtcatgcaattgttttgcttaccagcagctgtcagatggatattacaatgaatgctttcatagcaaatgttacaacatcaaacataacaagcattgaggatgaagctgatggcacagggagatacagagagcttaccaaaggactggaaagggggccctggagtccgcatcaggacactgagtgccattcccggagtgcattcaagagtctagtgcgcgctggttcacaggtgtctctttttgccaactcatcataaactcctcagctgttaatgcagagtcgcttgctgcaacagtgacagagaactgttgggttgccggggctaattgctatttagctctttcagaagggttaaatgcattggttagcttgctgaaggtttgggagatagcttaggtgcgggagcactcaaaccacagggacgtggctgtcccacctgctctcgttgttgggggcattttaactcatcacctgatgctattggaagtagctataaaggacagctggtggttgcatttatttggagtcttaattcacctgttgtctctctccagttgtggttgaggttagaacactctgactcctagaattcgtacattccactaaacaagtaatatatgatattttttaaaaaaattattccatggatattttctccctttctgtggtttgtcttttcacatggttaaacatatattttgttgtgtagaagctttttcacttgatgtgatcccaattgtccatgtttgctttggttgcctgtgcttgaggggtattgctaaagaaaatctttgcccagactaatgtcctggagattttccccaatgttttcttgtagtagtttcatagtttgaggtcttagattgaaatttcagtgaaagagataaacattttgtgaagttatctatgtttgtatatgtgtgaattcaggtgtgcagttttattattttttgctcaaagtggaatactattttgattagtaccctcaaaccgaaatagtatttatgaagtccttagtgcatactcctgtgcttcaaattctgtagatgttcaataagtatttaaatcaatgaatgaatgaagggcagttatttgaatgactccattttggcttcatgtcttgtttggggatgttgagttcaaagttattacatccaaaccaacactaagtagtaatgttaggatgtgtcctatagacgttgttctgtatatagtatcaacagaattatgtagtgtcaggtatgtagcatccggggtcctacagcctatgtttgaatcctggctttatgcaacagactaggcaacctggaatggaatgaactacttagttttctaatcctgtgttgattatttcagaaaattaggataataaaaggacttactccataggattgttatgaagttgaatgagaaaaatcgacttaaatctttcagcactgcctgtaacatataagcacttgatatatcgtcgatggtactattattatttgcctaacattttgcttttggggaacacacagccaccaatttcccctctcagagatgccacttgacttagtctctgttggtcccacccttaaaattattgaaccacgtgctatcaggcatattgcagcaaaatatggtgctcagaatatcatggcttatgtattttatcttgctggcaaagaattctaaaaggtttaaagcttaaattagagcccacatttaaaccgagttgggagaaatgtaccatatgcctctccatcttgtgtgtggtgtgactgtaagtgagagtgaatgacaacacgccgggggctccagccaaaacttgaggccggcagtctaaatccagatcgggcagcctcccagcctctcccgattctgtctgcttgtgcatttgaccttgacagccaaggtctgtgtggttcctctttgctttctgtcattaatcagtcctgaagcatcttctagacagacagcttggttggattgaataatgcgtctgtggtttttttttttttttttcttcatctgatacaggcatgagttaaactacagtcgcctccattgctgaacttggctattgggctgggcagtattttcaagcggtgttttacctgaaaatgttctataaatgagttctgaatgttgtcttctccctgtcatagtgcctgtgattatgataacccacccttgtaagctttctcctatagcagaaattgttgccagaggaaggggagggatggcatgtcctttcactggcaagtgaggccagattttgactttgagtcactcttgagaatttagggggtggtcacatggtactgtgcaacaggaagtgatatttatcatgataagtgatgtttaccatgccccactttacaactgccgtgtatctcaaatgttatgagtataccactgaatgcattctttattggagagaaaaaaagttagcaccgtatagagaaatatatagttgctagaactgagaaagggtaagaaaacaagagtaatctgtaatttttttgttgcatggtccaaaaggcaatttctgttgcctttttatggtgatttggagtttttaagatgttttgacttatttaacaagctggaaactcatggcagagagaatgtttatgacttaccgaaaatcttatggaagttcaccacagagctttccttggaatgcaggtatcgagacttgattttcagaattttgcactagatttcctaacagaaacctcgtgatttgaaggggggagaatcatctctgcaattatgtcactgctaagctgacatagtaaccaaggggttagtatcagccttggaattctgtaaatatgtcttgggacaaagtggtatggaactacatctagtagattgaggaagaaggtcatggaattagaacatttctgttacttctaggcataattttcaggactaaggaattcagcatgagctgcatctgcctcctgctacctcctgctctctcccctgtatcaataactattaattctgtttccttccccatcgcaatttagtttggaagatgtcagtgctatttaacgcagcgagatctccccagcacacccctcgggaccagtccttgggtgttgggagggcattctaccctattatctgtagggtggctgtgcttgttctcatgccacatcaaaattggcattggtagctcgctaatgagtaggtagagatgggcttggcattttgtcttctgaaggaacggcagataagatgaataatgtcattcttagttctagttttgtctcttcttactgtctttatttgagcccctctacctccctcatttcttcttccttccctctccattttccccttccttcctcccaacacccccatacacatgcacagctcacacaccgttttacctatctcttaactgacagctttaataaggatggtcactaagcatcttcttataatttatgatagaaaatggtatgcaaacttcagagatacggtggtggagatccaagtttatatcttgagtctaccatgtaactctcaatatgtgctctagacgctctgtgtctgtttggttatctataaatcagcaatgataattgtactgacctcataaggttgttgggatgagtcagtaagattatgcatgtgaaatgcttagcacaggttgtcatgcactaaaagatttccgtaaacattgtttattatcattaataaaaagcatctttattgagatccatctcataagatgcaacaccaaagctaatatttcataacagacaagcactctttgagtgatatattatgtcgaaattcaattaaatgtcccaactcagtgtgttggaactggtagcctgaaaaagtcccattcatctgatggctgtgaaataatgagaatgtttatctttgttccatgaagaaatgtataattaaagcagtttgtgacgtacctcccgaagattcatctctaactctgtaatacatttagtgatttcaatgcaaatgaatcgtgttggtgaggcaatgtgttcatcctatgtccttatctgttctttgaaaacctcatccaaggctctggggactctcgcagcagattgaaaatccccttgctggcaacagctgattagactgaggagagacatgcatggggctggccaatcagattatctcttcgtgggagttaagaaatttgacacagccccagtgtccatattctttacatatatatacattatatatatatatatatatacattatatatatatactatatatatatatatatatatatatatatatataaaattcagtgagaaggttagtaggaaatgaactctaggaggacaagagttggatagacattatcatttactggctaagtgacctagagcaagtcacataaccctgggaacctcggtttcatcaatggcaaagcaaagatgctaataggggctacttttaaaaaataaagaataaacacaataaaacaggcaaagcattcagtgacttgggcagcagtgagtgtgcagtaaatgctaaacattttgaattgtattcagccttcatttttcagcctgatttttaccttgattctcacattgaaactgcccatttctttgggtattttgggtcttttcctgttttaccctccccactgggtttgtcactgcacatccctccttccttttgaaagctctgttcttccttcattctcctggtaaacttgccgagtctctgcctcattgttttctggctttttgcattgcctcatcttcctgtgttcacacctaagcgaagttgctctccaaggttctgacctccgcctcttggctttccattgtgttttctcatgggtgacctaattcacacaacatgcctctaagctgatgaagcctagaatctcattcctgtatactaactgcctcttggatgtgtcttcctggaactcacacattctaagtaagtggaattccacatctggtcatcatttcataccgttccttccctcatcctctctcagttgatggccctcaggtcctcagtttagaaacttgttgttcaggctctgcagctcccccatctcaacctgaggtcctgcattacctcctgaagagccacagaatccagcatttgccttattctcactgttctttgtgaccagttcacctctcacccaggctgctgcaacgagcttctaattggcatttcttctctttccccttcaaatccctcatgcttgaaaataaaaatttggtcatgcctttcccctgtttaagtgttttcaggattatgaccaagcttagtaacgtgacttgttcctctctgctctcaggaacactccttgtttctctctttcaagaacagcctatttacagttcagtgcacgtaatgagcctgtactcatttctctgtctttatgtatgctgctccctggacccaccccattcccttctactatcttggcctgaaaatgtctacttatcttctaactctcgattcagaggcagccttcctccaggcattctttccctgagtgccactggctctttgtctcattttctgggttagggtttcttacattcatgggcactccaaatactctatccctatacatctatcttgatgcataattgtaaatactgtttatctgtccattttcaactttacgtttcgtgtaccttcccttgagggcaagagctttatgtttatctctatccttagtgattaatatggtatgtcatgtgtactaggtgcttaatatctgagtgactactagaatgaatgagtgagtagatatgaatagttttcaagatttttaggaaaccaaccctatttaacttactctgtgatgaatcttttagttcattcttttttaattcatgaagtctgcattactctaggccagtttttccttgcccccaaatctttcagatacggaatcagagaaacataagatgttagggttcacagttttgcaaaatgctgatgtaaaatacccaggagcaaacagatggcttaagaaaggtattaatcatacgacatattttcctttataaaatgccttcttacctaccgcctttttatccccattataggttttctttcatcttggcaatgtttagagtccgccatcttgccttgtaagccagtcttattatagcatttgtgctgtgcctccattttaactcttgacttttgttgctcccaccacacgttccttaaaagtcaatcaggagtttatgtatctttccgtcttctggactgagaaaaatttatggcctttagtagatgctcgttaggtttgtagaatgggccgggcgcagtggctcatgcctgtaattccaggactttgagaggccaaggcgggccaatcacctgaggtcgggatttcgagaccagcctgaccaacatggagaaaccccatgtctactaaaaatacaaaaaattagccaggcgtggtggcacgtgcctgtagtcccagctacttgggaggctgaggcaggagaatcacttgaacccgggtggtggaggttgcagtgagccgagattgcaccattgcactccagcctgggaaacaagggagaaactctgtctttaaaaaagaaaaaaaaaaaaaggtttgtagaatggatatgtgctctctctgaggtcatggggtgagcagggatgccaaaatatgcttactttgagtcacggaagcagtagccatttaagagccttcaaagggccagattgagtttatgtgatttaggaatcatgatcctaacacatctccagaaagagataaacgggcttgagaagaagcagagccatgctgggaaatagattgggtggaatttaaatagaagtctggatttgaagtaagaatcataaagactaggagtacttgtaatattcataataaaaataaatcctatgagaaccattaattaccatacacagtatgcttactatgggcctggtactgggtcaagtgctttgcattcattctcacttagtgcttcaaatagttctacaagttaggcttcattgtctcccttttcagatgcagaaactgaggcctcaaagagttaattcagccatttaaggtaacaaagctaccaggagtttgaattcaggattcctaagctcgtgctttttttacccctgcaccagaggaagttgtgtgcaggtctctgcatctgtcaagttactggatatgttattttgagcgagtgacctaacagggcttcagtttcatcatctatgaaattgacaggataacattatctttcagattttttgtaggtaatttaaataatttgcagaaaacgtttaacacattgcatgggatacagtagacaataaatctggacttttattaacgataaataattagcttcccattctgaaatatttcaatatggatgcgtggctgcgacttaaaaagccaaatccaccccccaaatgtgaattattgcctaactcggtccctgaaactggaaatagagaaataacatgcaattccagcagtatcaacattattattttcatttttttcctgatgctgtcagcttgttatttgtgctatttctttgaataatagaatttattcaggcaatttatccttaatacaagcgatataaatggggctatgcaatccttatatatcatgctaataatgtctggttcatcttttttttttttctccctgtttacatatggagacattgatttcctactccgtcctgtcttttattacattttctgcatcgaggtcatctctgtccgctgcctacactggattccagtagctgaagttgtgtaacatcattcagtgacattcttaaagcatctactatgtgctttcttcaaaaatgtgtgtattagagtggaataaaaaagaagaaagacatatataattgctgtcctcagatatatgttaaatccattagttaaaaatgtccacctagccagtgatttaaggacaaatagaaagctttatattgggaggttctgaaatagtgtcagttaaatgcatgcatgtcaccagaggctgtggatactatgcatacgtcttatttcttcttcctctgcaccctccctctggtggcccccaagcatctcttggtgactccccaaactgagatttctagttccagtgtttttctttttttttccaagcttgagactcatattttatcatccgtatctcccactgacccctggacacccttcattcgttgtgtctcaaactgaaatcaatacccctccaccccatccgcaatctgcaccatggtgaatcacatgtggtttcagcttacccatgttggggacctgcaagccaacactgggttgcttgttctatcatccctgctccacctgagcacaattaatggttaattcccatcaactaacttctctataatttcttgaactcaacctggtgcttctgtttcccgcaaagacaaaaccagataataggaacagtagaggaccaggatcacctgtttggtgcacaatgagtttctttttttttttttaatttttatttaagattcaggggttcatatgttgttttcttatatagataaagtcatgtcatggggattcgttgtacagattattgcgtcacccaggtattaagcccggtatccaataattatttttttctgctcctctccctcctcccaccctccatcctccaccctcaagtaggactcagtgtctgttgttcccttcgtgtccatgagtttccatcatttagcttccacttgtaagtgagaaaaagtggcatttggttttctgtccctgcattagtttgctaaagacgatggcctctatctacatccatgttgctgcaaaggacatgctttcatttgtggcttttctaacacattggaccaaaaggtctttaatctctttcataataatggcattgaattaactaatacttacctgacgcagataatttaacttgtctacatattcacctggtcctgtgcatttcagacttttgggggaaggatgaggggggtgacaggtgagttctcatcatttggcagccacttataagtgaaaacacaaggatgatttttatcatgcttcagacagaccttctgaggttagcgccaagacaagggtattgaatgtgcacacagaaaaagaaaagctaatttgagtagataaaaaggagaaagaatcagcaagacttgatgacaagatacattcaagggaataacacataggcaggaatgctctctaaacataatcagcatattacatgttttgtctatgactttgtgaatgaagcccacgggagaccttcttaaagaaaataaagagggagactctttttaagatgttaaaatagaggacaatgaatgcttttgcgatgagttatctctgtggaactgtgtgaccttgagcatgtcagtaacctctgtgggacttaattcatcttctgaaaacaagagattggattagataattcctaacattccatgcttttaaatagacttttatgattaggaatttggcaggtagaggggtggaagcataacatttaaaagttggtggtgattgagtcgagttagaagtgggttgaattatttttggaactaaagtgtacccttgctgaaatatagaataataatgagtctagtattaatatagcctggcttaagtataatactaatataaacaaaattatattgagggaaaatgatgtttatagagtacaccatcaagatgagctctagaaaaaggaaactaaaccttctctaaacaggtttttttttccctatcatccgcttctttttacattatcattatgttttccaggctggcagatgaatatcaaatctgcttttgactgaacattttttaaatctctctgatagaatatatatattttttcatttatgaaaagcaaataggtcacgtgttttctcttctgcagcaaagaaatatagcaaaagtttctatgctccgttccattttcttattgaaaaaaatatttaatataaatgaaaaatattcatttactttttgaacaaagtttcatcacagatctcttactcgggagtaaatactggttaaaacaagctaaatgcacattcttaataatttaaagtcagagaaccagccatgtgtaaaataggtgtatgttcacataattgactacagtattttgctacatggttaaatgcatgatttcccctaatagaatgccattgtggtctacatcacattttctagttcatgaaagtcaaatgagctgtgaccatagtctcccaaacttaatgggaagttcattttgtgacttctgagtttaaattgtgtctttccaggatgaatcagtagatctaaagcacattaatggatcacgtcaccaaaaggtctaatcctgagtgactaaaatggtagttctaattcagatttagtgcttttctagcacattggaccaaaggtctttaatctgtttaataatatattggttttgtattaactaaataatacttacctgatgcagataatttaagttgtctacatattcacctggtaccgtgcatttcaaacttctttggggagagatgagggggtagcagatgagttttatctgtgaaaaccagtaaagaagtagaactttatagacaggggctcacagtatatatttttaaaaatctgtatgggatgcttgttagcacaacaaatttacacactgctctgccaacactctcagccacagctacctatcagaaggttatgaagactagaagaaaaacacataagttatgtcctggactgtgcgaacactcatgagcacagccagaaactacagctggatgttcaccgacagccagctatccaaggtttttgaccttggacaatgagcaggggttgatggagatagccaggcctagagatggcaccatttggaagatacaaatggagatgtctagagggtgctggcagtaagcttctgcaaggaccccattggaaagggagccaaattgtttctgttatctcagggaacaccttgattctgaaagacagtgagagagcataaggctacctaagacttctggaaagatgaatacaactattaatatcagagctgcggcctcaagaacagccgggattctccctaatgacaagagggtggacggtctctctgcatccctttcctcaagccttttgttcaacgcttttcattgtatgccccgaaagagagcagttttaagcatctgcgatgtagtagggtcacctgatgtgagtgagagagagagagagagaaagagagaaatgaaatcaaatggtgtgggtgattccagttgccttcttgttagcaagagtgtataccatcagttttgcgataacacaacatatgtgttcctaaaaatcaccactctgtgtaaaatcacacaatataaaccatgggacttaaggggaaaatgggattaaaagcaccacactaaaaagtttcatcagtgacacatttaaaaaaatacagttttacacacgttaaatgattaagaaatacataaatactacaggagagataaccctttaccttgaagaagttcacaagtttgcttggggaaggacacgtctgaagggttgtgtcttgtgtgttattgtgatgggatagacaaggggacttacctgaaaccagatggtaaatggtaacaccagatgtgggtgggtatgactcaggaacacatgctgtgaattgacgtagcaggtaagtgtttgaggtgtgtgcttgtgtgtgtgtatttgtgtatttttatgcagctcatttttgctggatagagttttcggtgttaacttagtgaggtttttttttttttttaagtgaaatcgagcatgagcaaatgtgaaatccgcattatgctcaaatcgttccctagtttttttagctcccacatatgagtgagaacatgtgatatttgtctttctgtgtctggcttatttcgcttaacataatgtccctccagttccacccatgttgttgcaaatgacaggatttcattctttgtgtagctgaataatattccattgtatctatggtaccacagtggctttcttcattcctccgttagtggacatgaaggtggcttccattccttggctattgtgagcagtgctgcaatgaacatagaggtgcagacctcttctttataagggttttcttttctttgggagagagccagcagaaggattgctggatcatatggtagttttatttttagttttccgaggaacctccatactgttccccagagtggctatactaatttgcattctcaacaacagcgtataaggattcccctttctccacatcctggccagtattcattattggacttacagagatagagtggaatgatggttgccagaggctgagaagggtagcccggagtggggagagattggggatggttaatgggtgtaaaaatacagttgatagaatgaatgaggtctaatgtttggtgtcataatagggtgagtatagttaactatattttagtgtattttctaaaataactaaaagagtggaattagaatgttcctaacacaaagaaatggtaaacgcttgaggtgatggataccccagttaccttaatttgatccttacacattgcctgcctgtatcaaaacatcacatgtaccccgtacatatgtacatctattttgtgtccatgataattaaaaataaagaaaatttttaaaattgttccatactctgtcaactcatggacatacatttgcatgttcaaaacaagcattatggaattgactacaacttagagcatgagatggggcataaatattgagggtcccctaggtcaactcaggtccccattgtgaacatgtcagagtattggaagagaccacagttcccctctaccttgaatgcaaaccagccccttcatcatgtgcccaactgcattaaaaacaaaacaaaacaaacaaaaaaacataccttgagttgggagaaacacatagctatgtcagatcattaaccagtttctaacggagcaacttcctagggaagggtatgtttgaatccactggatgtttttgctttacacatttatttagagcctaattttcacatggctgtgtctctactgttctcttatctcaggtatcgatgccctgagataacttcattccaacaatcaaaacttgtctaggaagacctgattgctctgagagatttgccttgtgatttgatcatttcttgccatccccattgactggcgatcttcatggcagctttaaaggtgctttgaggttattcaatccatcttctttcttttagaaaggaggacaccgaggcttggagggaaaaaaagacttcactcaagaacttaagacaaaggctgtttcacagataactcatgcacctctagagttttcttatggaaatgcttaacagtatccctgttgggtcagtttctttcttttatgctgaaaaaaaaatcactttattgaggtataattggtattaaaaagctgtagatgtttaacgtatacagcttgataaattcggaggtaactatacatccaggaaaccatcaccataatcaatgctgtatatttgtatttatccatcacctccaaaagcctcctcccacgttctttatgtaatttattttttagtattgatttttcttttcattttgtttctgagacaggatctcattctgttgcccaggctggagtgcagtggcacaatcagagctcacggcagctcaaatattcctcctgcctcagcctcccaagtagctgggactacaggtgcatgccaccatgcctggataatttttcatatttttttgtagagatggggttctcactttgttgccaaggctggtcttgaaatcctgggttcaagtgatcctcctgcttcagcttcccagagtgctgagattataggtgtgagccaccgtgcccagcttaatgttgattttccttttgtggtaagagcacttgaaaaaaaaaatccagcctcatagcaaatttttaagtctacaacacagtataattaaccataggccttacattatacaggagttctccagagcttattgcattactggagctttgtaccctttgactgacacttctgtacttcccccttctccaacccatggcaaccacggttgtactttgtggttctgtgagttttgatgatttcagattcctcctaataatgggatcatgtagtatttgtccttctgtgtctggcttatttcattcagcattatgacctctgggtctgtccaagtaaatccaaaaaggatttacttcctttttaagactgagtaatatcactgcatgtatgccattttctttatccattcattgttgatggacatttatgttgtttccatatattggctattgtgaatagcggtgcaatgaacatggaaatgcatatatctcatggagattctgacttcagttcccttagatacataccatcatgggaatgcaatcaaaaccacaacaggaggtcaccgcacacttattgggagggctgttatagaaacaaacaaaccccccaaacagatgataacaagcgttggtgaagatgtggaaagaagtgaacccttgtctcttgtgtgttcatagaaacataaattggtgcagccacaatggaaagcagtttggaggtggctcaaaaacttaaaaatagaaatacatctgatgcagcagtctcacttctgggtctgcttctttcatctattgtgtatctcaaggcaaagcaacctgcctatgcctgatccctgcatacacaaacacagagaaatcatattaactctcaacctgttggtggctctgccagttctgttttgtttctttttttttttttttcgtgaatgactaacaatctaccatcagaaatgacattcataaaattatttctttctacagttatttctttgtttcttttcatctctaaacatgtcttattaagtacagggtggggagaacacagttattcctattaccactgatgttgttgatactcaactttggaatcttcccttttcctcccctaccctcacctcatctttcaccaaattcttcacaaggagagttttacaagctttaaactgcttccattttacagtggggaaaatgggaatacaaaatttggacatggattggtaatttcatgagtcaatgttgcgacaagattgacagcagcttctgtgaccactcatccagatgtattactgaaaacatgagggtgcaatgttgtggggaatccacctttgttatgtttttttctagaagggcctagaagcttctgaacttgctaggcacttgggagaaaattgattaaataaaaataatgaaatccatcccaccaacaaaaatagactgaattattgtttaacagaaattggaactaatgttctagggaggttatttgaacccaggcatagaagtgggagcatcatgatggtcagggaagaaagcaggtgacattagagactaatttgtaggcacatatacagtgtccttaaaatgagccatttatggggtaaagaaaagctgatcaaattgagatattttagaaagtatgcagtgtgaaggggttgatttctttataatgtttttaattgagttggatgaccttattgacaatggatgccttttgtcagcacgttgtgtgtgtgtgcctgcatgtgtgttcctcataaacccgtagctttctgcaaaaagggcattccaaaagaaagaggtgaaagaaaaatgcataaatgcacgataacacacgattaagttttgaccccatagattgttaaccttcaaagctaactctgcagtagcacaatattattagcaataaaaggaatttgctttgcccttttttaaattaccataaaccgattgactgagacagaatgatgttaatatttaagaagtaggacactagattctattatctcagaagctctgtcaccaggccctctctgtagtcctgttatctaattattgggcttaaattgcattagtgtgctagcaatttgtctaccattggaaaagtaattgacatttgggttactgcttcatatatgggagacttgctagctagttccgaagagtcctcttctgtcagggcagattagcttaatgttgcctagaagaaagggaagctctgtgttttaaggtatgctgcctctgtagctggttgcaatttggtattaaaatttcagttctgcatcaaagctgataagtcacctgagatgaaattgaacaaggttgtcgtgacaaagtaattaatggcattttttgactttcagatgactttaggggaagcacacttcttctctgcgtctgcttctgctgccatgtttataaatatgtatgcacatttacaaaacatctttaactgttgtcagatgtttctgcaggctccagatttatggttcccctgaattaaatagcaccaggtacatttggtgtacagcagtgatctggcattgacggtaaaggctgtgagtcttcataatatttcaatcatattttgcttctcctgacaccacacatcactgataggcactctctcttttttctatttctttgtataaaaatggaaagtggtgtgtttggttattctatttctagactttttttctgctcaactggttttggtttgtttaagagaagactttaagtacattcacaaatattttgcatttccctttgaacaagagcctacgagatcatacttttttttttttttttttggctatgtggagagcgtacctggaaaacagatgattttgatgtttttgatagccagtgcacctgaaagtcacaggcttctttcacttagatctggagtatatgtattctagggtcatctaaagagcagaacatagagatagccagccactattttctttaatgtgcaaactgaagatgaggctgaaaagtattcagaaattgattttaaaagttgatgtttctgtcttttaaggcacaggtcaaatctgactcaggaagaaaacttcttactatgatttgagcctcctctcttgcctctctcccctggctcactttagcgttcttggcttcctttcagttctatgggcaagccaggctctttcccgctgccaggacgttgtgtgtgctgttcctgttacctgggccgctctttcctgcttactttgccaagctagttacctcctatccttcaggaatctgctgaagcatcatgtccttagaggtctggttacttcctgctctgctccagttgttctcaatctcagtgtgattgcttccttctcaattcttgctatgataaacaactaatgtatttactcattttttgtcatccgctttcctcaccaaaacacaggctccctgatggcagaggtatcatctgtcctccttgtccctatatctccaggagctggcgatattaaatgttcaatgtttgttgaatatattaaattaaacctttcccaaatttccaccacaatacattttttaacttttcattttgaaataattatacactcatcagaagttgcaaagataatacaaatgagtcccatatactcatcacccagcttcccctgttgtaacctcttacatcagactagcacaatattaataccagaaggtgcagcaggctctccctcccttttactttaatggtgggtgatttcaacaggcaactgttatttgcttaatgtaatccttcgctattttatattttgggacattttatctccccttttctgatgcttccttcaaggacaacatcagctttttcagcacatggtgagcaccttgtaatacacttaattcttaagatagtgaactggaatgtgatcagaaagctactttttttttttttcaggtgcacttgcttaaaaaaaaattaaaaggtaaacagtctcaagttttatttggagttgctgagaagtttacccagcacacattttagctatgaccccctgcattcctgccaagcaggctcctgacttgggtcacccatgacagtgatcaaaattaaccctgctgctgctggactctttcgtttccctgtcttttccctttagctttctagtgctgttagtggcttctgagactctccttgttcagtgaagcattttgcataaggcacactttatcttttatctccaaagaaatggcagttaatgcaatctatagaaagccataaatgaggctgataaaattatctagcagccaaaaggttgctgcactcatttatctctgcataattcagaagctaaacgacaagattaggaagaggcaatccgtttgacagaggtgttactggaatgatgaaaatcaaggtggtttttgttttttccctcttacattttgtggggaggtggttaagagagggctgaagaagaagagattcaaggagaactcggtttctaaaatttttctcttgggcccaaaacatacctaagaaacagattgccatatattaatttaattatttgcctattgaataataatgcccttcccatttgatgtgcagattgtagaaaggtgacagtagacattttattttattttatttattttttgagacagggcctcactctgtcactcaggctggagtgcagtggtgcgcatgtaagtaactgtagcctcaaagccctgggctcaggggatcctcctacctcagcctgttgcgtagctgggactacagatgtatggcaccacatccagctaattaaaaaaaaatttttttcagagacagcctgttgcctaggctgagtgatgaaattttaaaatgtgactccaaattatcggtttacttcagaattttttttaacattagggagatgttgtagtgattaatctcccttaaaatttttatgtgtgtatatgtgtatatatgtgtgtgtatacatatatatgtgtatatatatgtgtgtatatatatagtctggcggtcaacagttcctttaatttctctgcataaaaactaaatgatagtatataatgaagtgtaacattataattatatatgttatgttttatataatgtagagtatgatccattttttgtaaaactataagtttaaaaaaatactgattactgataatgagtgatacatatttctgggtgatgggatatggaatttttttttaacttttgctttatacatgtgtgctttgtttaatttttttgttgaaagcaaacacctattgcattgagggaatatattacaatcattgggaagagtattttgtcaggggtagaagccgtttatttattcattcagcaagcatgtgcttagtgtaaggtgtgtctgaagttgagtagacatttagtggagggtaagcccaaagagtccctgcccctttggaggtcaaggctttgtctgtccccatctgggaacagggactcttacagacacaattctctcccctttatcttacaaagtgcctgatgtagatcaatcaacccatgtccgctgacggtgttgtgaagaaatacgtagcgctgcacagtggccatgttttaatcgttctgcaatttagaaattcaaatgaatggccactgctttaaagagtcagaaccttccatatttaaaaaaaaatatgcatttctggttcttcttggaaaattggagtctggccaaacactgcattcccttcctatcaaggcaaggattgatgtgaagtagtggcttctgtcttcgcatgaggtatagcctatgtggttttccccagtccccaccacttcctagagtgttccccctacaaggaggctaagtatctgtttatcttcaggccatatattgtgttacacttgctcacttcccccattttttttttgtgacccaactgggtctttgaagcatttatgctttttgtcctgtatcttacaaccttgaaggataattttgaaaatgtttgtgttataaaattggaaactttgcactgttttgagaagaggagaggacaacatagaaagcaggacaaacctgtgacaggagaagtctcagcatttactttaaaggtgaaatctgagcccttactcctcaagtagggagtttggttggtgtgaagctgctggagaatgtgaaggcatcttcacaaacaagcaaaacaccagggaagaggggccacgttttgtggaattaacctaacttttcagctgtctttagcagttggggttacattatgttcccctgggttgtgtgtgtttcttctgcatcaggagagatccctgcccaccttcagagaaacttaataataaacaaagaatgtacatccaaacttccaaacttccttgttaatccgtctatttccttagttgaggttgagcttaatgccgtctcatctaatacacgtaacctctccggtatcaggggccaaggccaagcaggcaatttgcagataaagtcaaacataattaagcagtaaaaactctgaccatacaggtggaatgaatgaatccaccaattgtgatcctgccaccatcctcctgccctaaaactcaacttgcttttctcctgagaccttctgaatagcaggaaagctaagcacagactgtctgatcttcagaaagggaggggcaagccattgtcactggatgattgaattattccttgtctggaagcaggtcgtgaaccagatgatgtctcaggttcttccagcctgagaggttttagctgcttgtcctacagtgaggcagagggaatcgatagaaacatggtatgaaggtctatgctcagtttcttattagtttcattgcttaattcctgcttaagcatctgctgctattattggtgacaagagcttgtatttctgtctctagactttttgtttgtttttttactttaaaagattttatatttcttctccatctaggaacatgacaaagttagaaatcttacaaaggggccaggcatgatggctcatgcctgtagtcacagcactttgggaggctgagaccggtggatcacctgaggtcaggagttcgagaccagcctggccaacatggtgaaaccccatctctaccaaaaatacaaaacttagctaggcatggtggtgggcgcctttaatcccagctacttgggaggctgaggcaggagaatcaactgcacccaggaggtagaaattgcagtaagctgagatcacgcattgcattccggcctgggtgacaagagtgcaattctgtctgaaaaaaaaaaacaaaaaaacaaaaaaacaaaaaaaaaaaacaccaaaaaaaaaaaaaaaaagagaaaggaaggaaggaaagaaggaaggggaaagaaaggaaaggaaggaagaaagaaatcttacaaagggatcagacacagtggctcactcctataatcccagcactttaagaagctgagacaagaggatcacttgagcccaggagtttgagaccaggctgggtaatgtagcgagaccctgtctctacaaaaaattagctgggtgagatggtgcatgtctgtggtcccaactacttggtaggctgagctgggaggatcacttgaaccctggaaggttgaggctgcattgagctgtgattgtgccactgcactccagtgcctgggtgacacagtgagactccctctcaacaaaaaaaaagaaaagaaaagaaaagaaaaaaattaaaaaaggaatcttatgaagatctcgtaataatgcctgattcttcaaagacatgggcacagacttgtcagctccaggcagtccttaagtgaacggtgcaatagccctagaggtgtcagctcagctgataccactttctcttaggaaaacacaaggtctttttttgtgttttctttgagggggccttgcattccaagtgtgcagttgagaaactgaacgttacaggatcagctgaaccaagtagagggaagaaaccctttggttttgacactgaagaaaacacacatagcactggggcaaactactgatggaaaacatcaagaaagatcttagacccttactccaggggatgtggcctaacggcagactggacagtaaccatgagacagagtgtttttgcttccatgagacagagtgttttcttcttctttttttttttttttggttagtgcctgaaatctagttaacttttttttttttttttttgggatggagtctcgctttgtcgcccaggctggagggcagtggcacgatctccgctcactgcaagctccacctcctgggttcatgccattcttctacctcagcctcccaggtagctgagactacaggtgcccaccaccacacccggctaattttttgtacatttagtagagacagggtttcttcgtgttagccaggatggtcttgatctcctgaccacgtgatccacccgcctctgcctcccaaagtgctgggattacaggcgtgagccacctcgcccagccaatctagttaactcttggtcttctacatgtgttagaatggttttagctttattgacagaaaatttgaataagggtagcttcagcaatatgtcaggtccccgtttgtaaagcaagctgagagaagtacctcttttctctctaggtatggcctttcctatctttgagtttaggatagctattaaaaatggaaagttacactgggtcttgtaattgtgcttctaagaattgattttgtacataaatgtgaaacctatcaaataaataacattccatccacttaaaggaatacatcttttatttatttatttatttatttatttatttatttatttatttatttttaacagagtctcgctctgtcactcaggctggagtgaagtggcatggtctcagctcactgcaacctctgcctcccaggttcaagtaattctcatgtctcagcctccagagtagctaggattacaggcacacagcgccatgcctggctaagtttttgtatttttcttttttagtagagatggagttttgccatgttggccaggctagtcttgaactcttggcctcaagtgatctgccaacctcggcctcccaatgtgttgagattacaggtatgagccactgtcctcggccaatatgctgttaagaatgaaacaaaaatctttatatggtattgacgttgaaaaatacctaatatacattgttaattggtgaaaaaagttgtataatagtatatatactatgattacttttatgtaaaagaattgtatatagacacatttgtataggtaacatactatatatttttaaaatatgcaatacatatgctatacaatatttaaaattacagataggtacacatatatgtgtatgtatgcatttataaagcatatatccacggctgggtgttttggctcacccctgtaatcccagcactttgggaggccgaggtgggcagatcacttgaggtcaggagatcaagaccatcctggctaatatggtgaaaccctgtctctactaaaaatacaaaaaattagttgggcatggtggtgggcgcctgtagtcccagctacttgggaggctgaggctggagaatggcgtgaacccgggaggtggagcttgcagtgagctgagatcgtgccactgcactccagcctgggtgacagagtgagagtctgtcaaaaaaacaaacaaacaaacaaacaaaaaaaaaacccactaatatgataatggagtaatctgcgtttttataattgaagatttccatagataagacatactctttaattttttctccaagacatatgtaccctatttgtaacctgaaaaaggtaagaagaagagaccaatagtaaaaaaaagtctgttattaacgaagaattgaagggccacctacttagaatagtcgttttacataaagaggcagacctgaacggccttttcccttaataagtgaagtatgttaattttatattcactgttgtggtcacctggagacatccctgcgttgtaaccttgtaggcttttaaaaagttaagtcacatcttctgtgccaaaaagtacctcattttgaactaaaaccttcaaaatggaagtcttgttattgagtttgatgtctatttattgctatatatttgcatttaaatacagaaactatatatttttttcttttttatgacccagtgtgtctttggggatagctttatgagctctttcttgaacgcttaattatttctttctaggtggctttgtcataggctgtcatgcttcattgaggtatcagctcagctgatctgttccactttctcttaggaaaggcaccattttggggccttcagtgggtaacagatttctgaagcttctcttagccccattctggcaacactgggctgatttacaaccggcaatatggaaaacctcctagacagctgcctcagctgcatttgaactactgcctgagagtctctggctgccttgacactctaacagaccctggcggcaaggcaggtaccgccttctgctatgctgctgatcattgctgaaaagttgcgtaagtcatgccaattgtttataacatgtatttaagccgtgtatgaacctgggagtcatgagtctgtgctcttatttcaatgtaataaagagaagaagaaatactggatggtttaaatcattctgtgcttaagagcaaagctgagaaccaccccaacttgtatccctctccatccctttgtctactgagcgaaagcgcattcaccatgctcagtctctcactctaagccagggttctcaacctcatcactgttgacatttggaactggacagttctttgttatgggaggggatggggtcaggggatgtcccatgaattattggatgcttagcagcatcccagctctctacactctagatgccagtacaacccactctcctaatcatgagaaccaaaatggctctagatattgacaaatgtcccctgggaagcataatcacctctgcttgagaatcactgctctgtcagatgtcccacccatctctcatactcaaataagtgtttctttcactccaagagcatgagtgggtgccttgttcctagttcctcaaatgagacaaacccgttgtcattgagacgttgcatgtgtacctctctccttctctcccactgtctccatctctctcatgtttcccttcttgtacccaccagccctacattgatgtcttgttcttcagaatctttaatatgctagtatgcattaggaatctccaaggatgaaagagtaggagggagagggagaaggagagagagagggggagagggagaaggggagatggagaaagagagtgagggagaaagagtgagagtgagagggagagggacaggaagagagggagtggggagagggagagagggagaaggacagagaaggtgagagggagagcgacagggagaaaaggagagggggagagggagacagggagagagggaaaagtggagaggaagagagggagatggggagaaggagacagggagagggggagagggaggggggagaggcaaagtgggagaaggagggagaaggtgagagggagaaggagagggagaaagacagggagagggagagggacagggagagagggagaaggagagagggagaaggggagagggagaaggaaagggggagagggaaagagggagaaggagagagggagaaggagagggagaaggagaaggggagagagaaggagagagagagagagggagaaggggagggagagggagagggacagggagagggggagagggggagagggggagggggacagggaaagagaaagaaggagggagaaggcgaggggagaaggagagggagtgggaccgggagagaaggagagggggagagggagagggagagggacagggagagagggagagagggagagggagaaggagggagaaggagagaggaagagggacagggaaagagggagaaggggagaggtaaaaggaaatggagagggagaggggagaaggagagggagagggacggggagatggggagagagaaggagaggagaaggagagggagaggagtagaggggaagagagaaggagaagagaagaaggagagggagagggacagtgagagagggagagggggagagagaaggagaggaggataaggagagggagagggggagagacaaagaggggaagaaggagagggaagggagagagagaagggcagagggagagagggaaaaggagagggagagggagagagggagaggtagagagagacagagaggggagggggagaaggaaagggagagggacagggagagaaggagaaggggagagcaggagagacagaagaaaacaggcagagagggaggaggagagggagagggacagggagagaaggagagaaaggaagagagggagagggggagagggagagaaggagacagagtgtgcatgcccatatttttttctgagtttgtttatttcccatgaacgctcccccaaatcccttgggactagcagttgtaaacacaccattgagaacattgcattcctttcttttcttctagatacttttcctccattaaccttgtctttttccttcctgtagatttttgcagcacattttgtctctccctcccttatggattgtttatcctgggtgatgatctgtgggcacatctcattccctaggtgcacacagctcttcgaaagcaagtattctgtggtatttaacccagcctgttttcttacatggagaaaggactgcataaacatcccaatgggttgaatgtgtttataacccagtatgaatcaactcgccacatgcccactgaaaggatccacaagatggttgcagtggagtaaaaggcagtgataactctctaactgggaagatcacagccgtaaaaagaatgagatcatgtcctttgcagggacatggatggagctggagtccattgtccttagcaaactaacacaggaactgaaaaccaaatactgcatgttctcgcttgtaagagagagttaaatgataagaacacatgggcacatggaggggaataacgcacaccggggccttttggagggtggggagttggaagagggagagcatcatgaaaaataactaatgggtactgggcttaatacctgggtgctgaaataatctgaacaacaaccccccatgacacaagtttacctatggaacaaacctgcacatatacccctgaacgtaaaataaaagtataaaaaccccatacagattttaaccatctactagacagaggtgatttcttttattaggctgtattccctctgggtcctcacagagaaacaggcatgagaccatcacgatggctgaaagaacagattctagttaatagttttgccttttgccaacaccattagctccccctcttaatccgaactgctgtatcgctgaagagagtgaccctctgtatttggcttgattttgttgtcctgagtagcctctgctagaaatatccacaagccacagcttcagccttcgagtgagcaaaagcaaagtatccaacaaactcaaatggtaactcaatcctgaaatgctgtaactttgatttgtattttccttctttctttattttttattttttcgcttagacagatatccccttctagctgtgctctctgatcccacttttgtttgtctctttatttcctctgcctactctgcctgaaaactaaaaagcaaattcttttatttctcacgtatatgcctccgaatgatttattttttaaaatgcagcttcacttgaatgttgactttttgaaaactttccctatttcactttttttttttccgctctcccttggaagctcttctttgataatcaggctggtcttctgttctttctacttttcttctgatcgttcaccttttgcccacttaaactgaagccctttggtgtatgcttggaatttcggcagttcaagttcaaaagaaagccctcttcaggtaacctgttctgacatatccgcatcttaacacaaagctttgctagattaatgggttggctaaaaacgtctctttgcttcagtcatagtcacctctgtgtatgagggtagcctcgtgtctattcatttaggggattcttttttttttttttttttgtagaattcgtctgaatctagaagcaaatgttattttattgaatgtcccactttcagagatatatttgagaacaaaaatgttgccaaaaatgtctgaatactaccgtatttcctttattggagcatgcatgtgttttctgtattttaacttttctgaaaagagggaagctgaaaaaaaggggaggatgtctcctacagtctcagtgatctctcagaattgagaaaacgtgataatcaaacatttcagtattatcgggaccttcctgggactgagcacacgtgttgaggggagtaccagggaaataaggagcatggtgaggagttaatttgcagtttgattccccctgctcctttgcatccagaagaagactgtgcgcctcctgtcccaggcccctgggtgtacccacatcgtggtgcatcactttgcatgttgacgggctgagtaacctgcttgtctcttgggaccacttcatttctcactgtgcttcagtatcgcacagacacctgacacctagtaggccctcacaaatatgttgcataggctgggcacagtggctcgtgcctgtaatcccagcactttgggaggctaaggcgggtggatcacttgagaccaagggtttgagaccagccgggcgaacatggcaaaactctgtatctagtaaaactacaaacattagcctggtatggtggcgcatgattgttaatccgagctactcaggaagctgaggcatgagaatcacttaaaccggggaggtggaggttgtagtgagctgggatcctgccactgcattctagcctggaaggcagagtgagattctgtctcaaaaataataaaataaaaacgttgcatgaatgaaaagttgtgtaatcagttctgaaagaaattttaaaaggaatgtgtccttccctttggtgctgttagaatgagtcccatacacattatttttaaccagatcatttgttgagcccacgtgcattttcagtagaataatattaaaaatgcctgcccattctccttgagtatgccaggtgaattctagagtcattcattgagctaagactataaacaggactagtgaagtctttttatttatttatttatttatttatttacttatttatttattgttttttgagacacagtctcactctattgcccaggctggagtgcagtggcacaatctcggctcactgcgacacctgcctccagggttcaagtgattcttgtgccttagcctgccgagtagctgggactgcaggcacccaccaccacacctggctaatttttgtgtattttagtagagatgggattctaccctgtttgccaggctgatctcaaactcctggcctcaagtgatcctcccacctcggcctcccaaagtgctgggattacaggcatgcaccactgcgccggccttagtaaagtctttctcttgtttttaataagaggaaagcccagcttttgcttcacctagttcacaacacgcaggatatcattgttctacatggaaaatttgtgtccgtggaattaaataatataatccctgggaacttccactggttcccggtctccttcttcagatattttatctgctaaatccgaagtcggaatctcagttaagcttattagttaagtcccaaatggagacaattgaagccagaaaaaaaaaaaaaagaagaaggagaaaaagtcctaattatagtttttcttcttaagtgctgcatgcaagtatgaatagggtattaactgtggttttcaacataaaagcataatagtcagtagcacgtatgtcaaaatgtaggcatattagaggctgttaggtgactcaggggccacatctgtggaacaggtacatatttatcttgagataccgagtcattaagaggggcaataaaaaatcaagtgtaaattgagagcaaaggtcacaatctgtggttggtgattttttatatgtctagcaccagcccttgctactttttctttagaaaatgagggccgagtgcagtggctcacacctgtaatcccagcagtttgggaggctgaggtgggaggatcacttgagcccaggagctcaagaccagcctgggcaacactgggagactgcatcactgcaaaaatacgcacacaaaaaagtaatagttatcctgcggtcaccagggcccagctactctggaggtccaggaggtcgaggctgcagtgaaccatggttgtgccacgacactccagcctgggcagcataactgagttgggagggaaaaaagtagaaaatatgtctcggtcaagtctgagcttcattttctattgatccagtcgtggtcttttccaaggaaattattgtatggagtgaactcgggcaattcacttaacctctcaattgctttatctgtaaaatgagaataggctgagcgtggtggctcatgcttgtaatcccagcattttgggaggccgaggtgggcagatcacttgaggtcaggagttcaagaccagcctgaccaacatggtgaaaacctgtctctactaaaaatagaaaaaattagccagctgtggtgttgggtgccagtaatcccagctactcaggaggctgaggcaggagaatcacttgaacccagaaggcggaggttgcagtgagccgagattatgctatcgtgctccagattgggcaacaagagcaaaactgcatgtcaaaaaaacaaacaaacaaaaaagagaataaactaattctcgtatcgattgtgataatacatgaaaagctcttagcacaaatgtaacataagtattcagtaaataggtgtccgtgtgtgtgtatcatccatcatctactatttatctttctgtcttcatctgtcatctgtctgtttctatatgaatatataaatgtatttatctatatttttctatatgtacatatataagggtatttatcatttatctgtatatcatctatctcgatataggtatctatatgtgtgtgtatatatatacatctctgtgtgtctgtgggtgtgtgtatatgtatatatacattcatctatccatttatcgtctatttctccatacaaacagacacacataacatacatttactttcttgaattgctaaattgactaatgcagatacatgttcatttttgtcccatagatactaggcccacccctttattctttaagactcctttaacacaacctgttggatttagaagactccactgacactggagggattgaaacaagagaaaaggaggaattatacttggtaatagctttcatttctcctagattccctcagtcctgtagactatattgagttataagtctttgataatttgtaatttgtatcattaatatctctcagtcagtgagatcttttgattaaccaaaacacagtgaaatttctgaaaagcctgttttattgtagccataaactatgtttacagagctgtttcttctaagagcttcaaaatggtttgtggtgtgtgtttactgtagatgtatttttcattaaaaagtaagataatgctatgactaaccgcccccccccagtggaaaataatgaagaaaacaaaagcattcatcacagtacaatcagcattaaatttgtggtgcctttcttccaccctcagatgtattttttaatttatgtgcctatgatcataatgaacatttaacttttttaaaataaacattgtcctatatgaaccaagtaatctagtctctataatcataacttaaccttaacttgtaatggctatcaaatacttcactctgtgtgtgtgtgtgtatgtgtgtgtgtgtgtgtagctatataacatttaattgtcattatattaggtgaaattaaattttactctttttattctaaataatgccccaacgggtaactttttccatatttaaaattatctctttaggccatatttccagaagtgtaatcataggattagggaaatggaaatatcttgcacagtactttacatgtatttccaacttacttttcaaaagggtcatagcaatgtatataactactagcaatgcatataaatgctagtttctctacatcctcaccagccttgggttttataattactttacattttcctaatagaaactgtatcactgctgtttaatttgaatttcattactagtgaggttgattgtttttatatgcttaatctctgggttcatcttcctaatagaggcctgccttgtgttttaacaattcagctgcccagataacacttagagagccatgagtaaaagcactctgttaagcaaaacaaaagccacatatttccaaagactgtattgtataatttcaatatgagtcagtattccaatgtgtcatccaaacatttcctatcatttgttaatatgatcttaagctaaattaatgtattagtccattcttatactgctaataaagacatacctgacaatgggtaatttatgaaggaaagaggtttcactgactcacagttccacgtggctgggacacctcacagtcatggcagaaggtgaaggaggagcaaagtcacgtcttatgtggtggctggcaaagaaagcttgtgcagaggaactcccatctataaaaaccatcagatcttgtgaaacttagtaactaccacaagaacagtatgggggaaactgcccccatgatccagttttctccattttgtaccatccttgacccaagggaattattcaagatgaaatttgggtggggacacagccaaaccgtatcaaccaatatatgagaattgatttatttactttagtccctatcataagggaagcagtggtccttcttcatgtttcctcatgtcactttttaatgagcaagtcatgcacaagacaccatatttaagaagtatggaagggcacacagtgaaagatgagtgactgaagacatgtttatttccagcatgatgtctttccaaacaactagccaaatatgtagtccaatggaaatgaatgttttagactagagagatatttcttttataaaatacaatgttatgaaataactctcgtgggtctttggtattcaggtgtggcaaatactgttaatttgtaaatcaaaattatttctgaccttcttctataccttgctgtcttccgctctagaggctgaaagactaatttaaaaaatttcatgcaagcttgaaactttctggagacaaaaacataacaaaaagggttagacaagagtgatgtacgttttcccttccctccttctgcttgcctggagcatagaagtgataactggagctgtgacaattgcatcatgaccatgaggagaatgtcaggaggattgcagatacatcagctctgacatagcaaccatcggcttctagatgaggacttccctaactttagtgcacataacaatcacctgaaggctttgttaagccctggattgctgggcccctgttccagagactgtgattcagtgattcagtaggtcttgggtagaatgtaagaattttcttttcttttattattattattattattattattattattatgctttaagttttagggtacatgtgcacaatgtgcaggttagtcacatatgtatacatgtgccatggtggtgtgctgcacccattaactcgtcatttagcgttaggtatatctcctaatgctatccttccgccctacccccaccccacaacagtccccagagtgtgatgttccccttctgtgtccatgtgttctcattgttcaattcccatctatgagtgagaacatgcggtgtttggtttgttgtccttgcgatagtttactgagaatgatgatttccaatttcatccatgtccctacaaaggacatgaactcatcattttttatggctgcatagtattccatggtgtatatgtgccacattttcttaatccagtctatcattgttgtacatttgggttggttccaagtctttgctattgtggatagtgccacaataaacatacgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaacaacagtgtaaaagtgttcctatttctccacatcctctccagcacctgttgtttcccgactttttaatgattgccattctaactggtgtgagatggtatctcattgtggttttgatttgcatttctctgatggccagtgatgatgatcattttttcatgtgtcttttggctgcataaatgtcttcttttgagaagtgtctgttcatatcctttgcccagtttttgttggggttgtttgtttttttcttgaaaatttgtttgagttcattgtagattctggatatcagccctttgtcagatgagtaggttgcgaaaattttctcccattttgtaggtcgcctgttcactctgatggtagtttcctttgctatgcagaagctctttagtttaattagatcccatttgtcaattttggcttttgttgccattgcttttggtgttttagacatgaagtccttgcccatgtctatgtcttgaatggtaatgcctaggttttcttctagggtttttatggtcttaggtctaacatttaagtctttaatccatcttgaattaatttttgtatgaggtgtaaggaagggatccagtttcagctttctccatatggctagccagttttcccagcactgtttattaaatagggactcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgagggctcttttttggttccatatgaactttaaagtagttatttttttccaattctgtgaagaaagtcattggtagcttgatggggatggcattgaatctataaattaccttgggcagtatggccattttcacgatattgattctttctaaccatgagcatggaatgttcttctgtttgtatccttttttatttccttgagcagtggtttgtagttctccttgaagaggtccttcatgtcccttgtaagctggattcctaagtattttacaaattcttaggcagtgctgatgttgctggtctatggaccacacttggagtagtaagatgctcgattcattatgtgagaacaaaaaagccctatttttaaagtcactgcagttggtgttgcttgtaccctaaaaaaagtgaactgattcacctgctaggtctgcgtatttctgcttcatatgtaccacctactctagaaagagatgagattatcaatctaattgaatgtgtgtgaagatgacagaagcaacaatcagatggtcaaaagcagattaagaatcacttacttggccaggtgcggtggctcacgcccataatcccagcattttaggaagctgaggtgggtggatcacctgtggtcaggagtttgagaccagcctgaccaacatgggaaaccccatctctatttaatacaaaaaattagctgggtgtggtggtgggcacctgtaattctaccttcttgggaggctgaggcaagagaatcgcttgaacctgggaggtggaggttgtggtgagccaagattgtgccattacactccagcctgggcaacaagagcaaaactccatctcaaaaaaaaaaaaaaaaaaaaaaaaaatcactcactccaggaatttggggctgtccccagtcctgtgtaggctcctttccttctgggaagtgatggactacaagagaggtagagaacagtggaagagtttgaaggtgatctttaacaatggaaggaataacagctacaatcccaatacgtgctaactgaactgctaactgaagtaggagagttatatatatatatataaaatagtgcccctgttctgaaagcttggtatcaaaagctgcagggtttgatgtttagcaggaaagcattgctataacttgcgtatcttctaaaaaatgtgcccacatcctcccggtttgccttgggaacagagagaacttggttatgaagcccctttctccaaggattaattgaatcaagatcaaccctatctggaatgtacatttaatacccgggaatgatgtcagtaatatatgtaagagatttttatattagataactgctcattaaaagtcaatcctttcccccagggttttaaaatagaaagtattcaccttttgcaaatgaggatagtgaaatttactttaacttctgccacaatgaaaactggaagaaagggaattgctcacaatacaatataactccaccaaatttgcataatttaggcataaaatgtaataccctgctcacactcttttgtcttgaatgaaattggttttcaagtaatgtggggaatcataaccagctttaacaaaatggatcatgtcagaaagcaaaagttcctactagcctaggagacatgactgaagtgtgaatgcagtgtgcaacatctttacaaaagttgttcttgtgatttaatgcaaaagcctttgtagactttacagaaacactgaagccgtgctttttgatagttaatgggggaattaaccatttgaaaccttaagacaatctttttctaggattcttaaaatcatgggattgtaacaattctaaggatgttaaaagtgatatacattcctgcagttcctttccaaagatcacagagttctttgtgtaaattagtatttcccaggcctggtgcagtggctcatgcctgtaatcccagcactttgggaggccgaggtgggaggatcacctgaggtcaggaattcgagaccagcctgcaacatggtgaaacccagtctgtactaaaaatacaaaaaaaaaaaaaaaaaaaattagctgggcatggttgtgggtgcctgtaatcccaggtactcgggaggctgaggcaggagaatcacttgaacccgggaggtggaggttgcagtgagccaaaatcatgccattgcactccagcctcggcaacaagagtgaaactctgtctccaaaaaaaaaaaaaaaaacaaaaaaatatttccaataaattttcagcaatgtgaagtaagcctgtctatgtctttcctgtggcacaggtagtgaaactgaggtcaggaaaaggagtgcattgcccatgaccactcattgaagcggtgttcaagttttcaaggcacagactttctgaagcatattgtatgaattggtttttgatatattatggatagtgatatagtaaaggtatgaaagtcaaaagaattactcattgaaagcattggcctccaagagcattttctccccaaacctcttaaggggtttatatgaagtttaaatgttgatgttttccattatcttgctggctgtaggctttgaccctcactttctttcatctttaaaatgaagttgtaacagtatatgcctcatgtgtttcctgtgataattcaacagttaaaatgataatattgtggctggacatagtgccacacacctgtaatctcagcagtttgggcggtgaggcggctggattgcctgagctcaggagtttgagaccagcccggccaacatgatgaaaccccatctctactaaaaaaaaaaaaaaaaaaaatacaaaaattagctgggtgtggtagcaggcacctgtaatgccagctacttgggaggctgaggcaggataatcgcttgaatctgggaggcagaggttgcagtgagccgagattgtgccactgaactccagcgtaggtgacagggcgagactctgtctcaagaaaaaaaaaagtaatattattattactgcctcatatatctttttgttgcagacactattagctgtctaccctggccctcctcagaggtgagcatgaaccagaattccctggaggccctcttaaaacgcaccctcagagcgtttgattcagtgattctaaaacggagtctaagaatttgaattttttaaaagttctcatgtgttgccggtgctgcaggctttgggaccacattttcagaaagagtgttttctcttgtgaccattctccaatgttctgtgtttgttaggtgtgacaatgggtccatctagagcaaaaacaaacaacagtagcaaaccttgatttctcagggttttttttgcatttgggagtggccgtggagccagtgatacagaagtggaagtctgcagggtagggacagaagtgagcttgtacacaccttccagccacacgcccttctcctttcaggcttcctcttgcctggaagaagtatgctggtcagaaagtagggcagccatctatgaccatgagtccagaagccacactggacaatggaacaggaatattggagcataatgagttcctcaagaatagctgaagtagctctatagggccaacctccaaacttgtgttttgcgataaaaaatgaatatgtggttactaactatagaaatccttaactgaattatttctctcaggtacacacaaatcttttggacttcttattttaacaaaaggagaggtaaacagtagggaggttcctcaaaaaattaaaaatagaactaccatatgattcagcaacctcactgctggattatacatccaaagaaaatgaaatcaatatatcggagagatgtctgcactcctgtgtttattgcagcactattcaaactagccagggatatggccaggcacggtggctcacacctataatcccagccctttaggaagctgaggtgggtggatcacttgaggtcaggagttcgagaccagcctggccaacatggtgaaaccccatctctagtaaaaatacaaaaaatatctaggcttggtgacacgcgcctgtattcccagctactcggggccgggggagcagtgcttaggtgggagaatcgcttgaacctgggaggcagaggttgcggtgagctgagatcatgccactgccctccagcctgggtggcagaatgagactccttgtcaaaaataaaataaaataaaaactaaacaaaatagccaggatatggaaacaacctaagtgtccctgaacagatgaaaaggtaaagaaaatttttaacacacacacagacacacacacacacacacatacatatacatgccatgaaatacaattcagccttcaaaaaagaaggaaattctgccctttgcaacaatatggttgaacctggaggacattatgctaactgaactaagccagacatagaaagacaaatgctgcattatctaacttatatatggaatctaacagagtgagactcatagaaacagagtaaaatggtggttaccaagggctggtggctggcaggggagagttgttggtcgggtacaaaatttcaggtaggcgggaggagtaagttcaagagatctattgtacaatatggagaaatcatagttagtaccaatgtatggtgctcttgaaaatcaccgagtagattttaagtgttctcacacaaaacacaaggacgtgaaataatgtatatattagcctgatttagccattccacatgtatacatgtttgaaattttcatgttgtacctgataaacatatataattttatttgtcaattaaaaataattagaaacaaacaaaagtagaggtgaaggaaaaaagttcttggcgtttatattaaatgatgcacaaatcccctgctgtgccccacaattgttggaggacagtgggtggatgagacacacagaatagactcttccttggcccatcttattgagagaccatgttgtgcagcagtgtcatcctctgagacgtagttaagataaatgacatctccttaccttttaccccccgagactataatgtcattctgtagtctgaaaggtcatttgtaaagctcacaggattgctttagctgttaaaatagagagcaaaactcaaaagcaaacctctttctccaaggaaaatactatactttgaacagtctcatcgttctcctgtgattctaaaccagttcctctgcacgcagtgcagaaactagatctctcctgccactaggctcacaaggactcttgtggatctcgttttccccctatcttttgtcttacagtttccaccctcccttttgttctgtgtgtttgaatcaagaaccggcaaagcccacaatgatgtttgtgagcattaagtgacgcaaacacaataaaggattttgcttttttgagccgctcataaaaagagataaattgctttagctttttatgcatgtagaaaaatagagtatgagctaatagtactgactgaagaggaaccaggaagaaatttagtatgcatataaatttaatgcaaaataaaaagccaaatgtaaatattggtttccttccagattttcaaggcttaaaaaaaaaaaaaataagattttctttgcttgttatatttctgctgatggaaaacatcctttccactgttggaaaatgaatagttataaatatagaatacatatatcttagactcggtggtctttaaaattaagagtttggacttttcttttgatagaatgtggcatgtagcatatcgcatgtcttagaatattatttgtcctcgcgaaagtgatcctcatcccttattttaaaggaaaagaaaaggtatgattctccttttgtgcattcagtacacaaaaaattgcctgttatctagggtgtacttgactatggatctccttttaagtcaagactacacttacatgatggaaataataatggaaaattgtagataataataaatatatttttactccatcttcttcttaaaagactttatcgcagagagcaaatagcttttccctttgcaaaaacaagatgctagaagcatagaagagatgaagttaagcaattagtgattggaatgagttgatcttttaatttttttaaataacaataatcaccaatctcgattggacacttactatatgcttggtaattcatgtgtattaactcagttaataattataacaatgttgttataattataaggaaaaaatatttattatctccgtttcacacatgagagaattggggctttaactaatatgcctctgatcacgctattattctgtggagtgctcagaatggaaggtcagaccaccgcgttctaaaacttttgcttttaacctggtagtgtattagtcagtgtctgctgcatcaaaccgccccaaagcctagaggcttaaaaccaccatttattcaactcacaattccgtgggtcaacagtttggactaggatcagctgggtggaggagtgagcagaagtataaagaggtctgatgagggagtgagattagcagcttaatttcttcacgcataacaattcaaggggaccttcatttgcctgattgagcaaatatcttatgcggatagcttaaggaaagagctgcacacctgggctgtgaccttctgggagatgaagtccaaggacatttttagatatggatacgcatagtacaaagagatggaatagaaatgctaaagaaacatatacataaactccttggtgtggatgattcactcactgactgtatcgtgtgccatcctttatgcagacagtgtcaaatgttggtagaaaatgaagtagatgtagccctctgactttataggggcttgcagtctgggaggagaaatagtgaaccagtaaactgttacatcagtgaccacttgtggtacatgttaggtatgaaatagactatccagatagaaactaattaaagaagggtctatttgggtaagttggccaggaaaggttttttggacgaatgataattaagctgaaatctgaatgttgagaagggtacagtcaaggaaaaggaagtcggggctgttttagagatagaggggtgtgtgtgtgtatgtgtttgtgtgtgtgtgtgtgtgtgtaggtgtgtgtgtgtgtgtgtgttccttataagccaacaggtaccgaatttagtgtaggtctaagggatatgttgaaagatgaaggttataagtggaggtttccgtgtttaaattcagtgatgagactctctagctcttctcattttcttaaatgttgcccaaagaatcccataaacatggaaggaatcctacccaggtgctatataaagataaggatagggagcctcttggagatataattgaggagcaccagatggggagtaagatttggcttctcatgttggcattaacgctaatttaccatgtgtccttggcaagggcactctgcctgtccagaatttagttgcctaggctacagtgattgcctgttctgaatggttgatgagagctatgtggagaaaagagtctgaggccacttacaatcactgtgagccagaattctgtaattgattaggcatgtctgccctggacttggaaggagcaagtggtgttgtgtatgctgtatatgtgccattctctgatggccttttattttccagcacaatgttttctatggcttttatgactaattggaaaaattctgtagctttccagtttttttttttttttttttttgtcctggtattttaaaaatgcagcaataattgaaaacaatgagggaggaaaataaatacatcaaaacaatagtctgtacacttacttcaaagggatcaaataaagcaaattatgcacgggagggaggtggatttgtacttccctcgtttgcaatattattagtgtgattaatatacaaagaccaatatttcctgaaattcataatttgccctattcctccgtgagctttgtgtttcccagaataatcatgctgatccatttccttaaaaatgtattgaatgcctaagtgctcattttgcaagggcagcagcataattggacacagtggggaaacagcagagaagtggtttgcttcctgaggagaggagaatgtggtgtgagtaccggctggacggaatgtcacaccaggagggacctcatctctgcaccagtgtcactgagcagaatgcttaagggctatttatggaattagggctggaaaactgcagctaattctcaaagaagggagggcttccctggattataaaatatgtgttcttttgaataatgggaccgaatgagagtagaatgtttcagcatttttttcctaacatgacagccctttggggatcctggtgattttacaactggatttcatcttcatgaaattctgttatgtgtgatcgtttctgctccacccttccccttaaatagtcactttaaaagcatctctatcttgccttggagattgactttcttgttccagttgtctagaaaagtatttctatagtgtgagctttagaaactaggaacagaggaggaagatcggagtccttaggttcaaacctatttaaggtccgtgctctgccttgtgcctgcctgtctctgagtttctcttaatgcttttccaaaacagttcattaatgcagtgacctcgaggtcttgctcagatttgcttccacttggactggtgatgagaattgctggtgaagctgggtccctatgtgtttgcaggtctgtttagtagactcaacttctgcacatgtagcatccacatgtccagtctcttctgtgagatgtggacagcgtcagtgccagcataagggaatcagggtttgagaactctcaatatgggcagggtagccgtactgtgtaaacccatggagcgccattcccattgaattctacatcgtctgctcatcactatgtaggccccgatacagatctaacagggaaattcttgtagtttactgaggcagggccagctgctgggtgagatagagagagatgaggctggaaagtgggtatgagcccgatcacaaagcaggttatgtattgtgattgggtttggaatttattctgaattcacttgccgtcagtggcatttcagagaggcccctttagctgcacttgaaaggatgagttagagaagccccaaactggagggaagatacattaagacatgattgcagggtgaggtttctgttaattccttgcatctctatggctagcaccatcctgatccaaaccaccatctcccccgggtggttgcagtggggatctgacgaacccctgcaccccactcgtccccacctccacaccgcaacccaaacagcctgattatattaccccataggcagcctttcagggacagggagttcacattgctctcaggaaggagacaaaaatccttcgtgtgggtggaggcaaggtcttgcaagatttaaatgtcctcaccctctacattgttcactaagtctccacaccacaccagtcgccttgattttttatcaaagaaatggggtctcactgtgccacccagcctggagcacagtagagcaatcatagctcactgcagcctccacctcctggcctcaagtgatcctcctgcctcagcctcccaaagtgctgggattacagacatgagccaccatgcccatcccaactttattttttttccatccgtcctccatgttctctgtcactaaatgtggttcactctctctggaactttcctaaaccattttattacccctgtcttagtctattttgtgctcccataatagaatacctgagactgagtaactgataaagaacagaaatgtattttatcacagtttcagaagctgggaagtccaagatcgaggcaatagaaggttccatgtctggtgagagctgcatcctctggaggggaagaatgccgtgtcctcacatggcagatgggcaggctggccaaacactgtaaagcttcttttataagagcattcatcccactcatgaggggaggagcctgtatgaaccagtcacctcttaaagcccccacctcttttcaccatcacagtggcattaagtctcattgcccttcaccacgcacttgtttaacttgcttaatttttatttattctcaaaattcctgcccactgtcaattttttacagaagctaaatttcccctgtgttatctatcgaaaagcaagtatctctcctttttggcatttagttcagttgtaaatttacatttgtttatgtgattctttgattattatcttccttccaaaactgtaagtcccatgaggataggggctatttttattggatccttatcatttacccttcctgccacttagcatggtgatgtctcataaccagcagcattcagaaatagttttgaaagaatggataagagacagtagaagtctgaatgaaggcttcaggaataggagcagagaaatggggtggatgtgtggggttggtactttctgtgtcttaatgttctggagaataatgactctcaggtttttatctgggtgactcagtaatggtggcattgtaaacttaagtaggaatttttgaaggaaaacaaggttagaaatgaatacaacaaaggggccttttcatggtgaagaagttctgcatcttgattttggttgaggttacatggatctatacatacacatgaaccacacatacgcatgaactacacacagacacacacacacacacacaggcacacatgcagtgaaatgtgaacaaggtctgtagattgcactagtatcggtttccttgtttggatatttggttacaggtttggaaaatgtttccattgggggaaactgggtaaattgtgcataggaggactctgtaccacttttgcagattcctttgagcctgtaattatttcaaaataaaggtaaaaagagagggatctaaagattggcagggacattggtaaattcagtttgcaggatatggaatataatttgctccttacagactccactaagacctcacctctcctttttgactcaattattggcctgaaattcttgttggctcttcttgcattctaagagtgcagggctctgctgacctgtccacctggctttgttttcacccttcttccatgtggtcattcacatctcggaaggcctaactcccctcctccacacagaatgaatcacaaggtgcaatacttactttccacctattcagcagcataaaaagtccaagcaggtaggattccctccctttccaccagccccagctgtctgtctgtctgtgtgccatgccgcatatctacccagaggaaaagaggtcatcatatgaaaaagacacttgcacatgcctgtctatagcagcacaatttgcaattgcaaaaatatagaaccagcccaaatgcccatcagctgagtggataaagaaactgtggtgtgtgtgtgcgtgtatgtatgtgtgtgtgtgtgtgtgtgtgtgtgtgtgtgtgtgtatacatgatgggatatttatacatatatatatacttacatatatatatacacatatgtatatgataggatgctacttagccataaaaaggaatgaattaatggcattcacagtgatctgaatgagattggagactattactctaagtgaagtaactcaggaatggaaaaccaaacgtggtatgttctcacgcatagtgggagctaagctacgaggatgcaaaggcacaagaatgatacaatggactctggggactcaggaggaaagggtgagaaaggggtgagggataaaatactacaaattgggtgcagtgtatactgctcgggtgatgggtgccccaaaatctcacaaatcaccattaaagaatttactcatgtaaccaaccacctgttccccaataacctatggaaataaaaaaaattcaaaaaataaagtaggaaagaatgacactgacaaaatctataggaaatgggaggctatttgctggactagagtttctcataggcatgatttattccattgcttaaaagcaaaacatattccatactttatttttctaataaagaagagcaacatctgacttttactgagctcagtatgcctttgttgttgaaagagcaagctctggagtcagccctgattgaattcaaatcctggcaccaccaccttgaccttgggaaaactactgcatctcactttgtcctggtcccatttgtgaaacaggactaatagtacctaactcataatctgtggaaatcagctacaatgatgagctccaagagcttagcagagtacctgaaatacaggaaatacccagtaaatattagcctttattatgatgtttatttttttttttttgaggcagagtctcactctgtccctcaggctggagtgcagcagcgccatctcggctcactgcaacctctgtctcctgggttcaagtgactcccctgcctcagtcacccaagtagcagggattacaggcacgtgtcaccatgcctggctaatttgtttatttatttatttttgtatttttagtagaggtggggtttcaccatgttgtccaggctggtctcaaactcctgagctcggatgatccacccacctcagactcctaaagtgctgggattacaggtgtgagccaccacgtctggccttattatgatgtatttttgccagatgctttttgtgtgttatgtccacacgttttaaaaatgtatccgtaagagcaactttacccattggatattttattcctatagtgtaagtgaggaaatagaggctcagagtattcaagccatatgcccaaggtcacacagtggcacattgtaccatggagattacaactcaagtctatttggccccattgtaggtcacaatattctatttcatctctaaacaaactcaggggaccctagcattataaatgcaaaagaatgtttaatgcagataattcctcagcaaaatggagtgtctaaggaagtcttcgggtttgcttttgttctgcctgagccaaaatcatggtacttactaaaatcttactggaagtccctaaaatcttactggcaagggtacttttattacgaacacatcttcctataaatttcgttaggtatttcgtctttgttatcttgctaaagcagaaggctgttgttctggaatgtgaaatttatgaaattgcaatgttagaaggtggaagtaaatcctacttttccctgtggaagaagtttgagaggcagtgcttgggcaagtttcatccttatatggccaggtctgaccctataaaggtgaagggctattatagtggggttcagagaggtaagccaacgtgcctcaggttacctaactagtaactgagccccactttcatcagttctaaaaccagaaaaagaaatacctgccttattgggaggccaacacaggtggattacgaggtcaggagttcaagaccagccttgccaagatggtgaaacctcgtctttactaaaaatacaaaaattagtggggcgtggtggtgagagcctgtaatcccagctacttgggagggtggggaagagaattgtttgaaccagggagatggaggttacagtgagccacgatcacaccactacactccagcctgggcgacagagtgagactccatctcaaaaataaaacaaaataaaattaaaattaaattaaatgaaattaaattaaacaaagaaatacctgccttatggctggatgcgttggcacacacctgtaatcccagcactttgggaggccaaggtgggcgggtcaggagggcaagaaatggagatcatcctggtcaacatgtgaaaccctgcctctacaaaaagtacaaaaattagccgggcgtggtgatgcgtgcctgtagtcccagctactcgggaggctgaggcaggagaatgacttgaacctgggaggcagagattgcagtaagctgaaatcgcgccactgtactccagtctgggtgacagaatgagactctgtctcaaaaaaaaaaaaaaaaaaaaagaaagaaaagcctgccttatagggttgttgggaattagaaatgtctgtgaagtatctgccacttagatgacataaaaatattgctattacagtgatggcattaggtctgcattcacagtggaattacagtatggccaggcatattataatgaaggtttttaactttcttagaaacgaaatttgtccttttgaaactccctcttcaggtttgcccttaatccaggaacctctatcacattacaggcgcccagcagcacatcttaatatatgttaattccctttatttctgatactggagaatttaaatagtgactctcctcgtaggatgcctcctggcatggtggaaattgccagaagacaaaataacagattttatggtacttcgctgtggtttttccatatgtccaaaccctatccgtagctttcatgacccagataaagtgtcattaagtatgtattagtgattctcaaccctggcttcaaattcgaatcagttgggaatgcattaaaaactatcaaaatttggccgcactccacaccaaacaaatgagaatcccagcagctttatgctttttttattctctggtttttattgtttgcaatgtcttgctcttgttacatttttctgactgactatttttttaaaatgtttttaatgtttaatttttgtggttgtatatatttatggggtacatgagatgttttgatatagacgtgcaatgtgaaataattttatcacggagaatgtggtctccatcccctcaagcatttattctttgttttataaacatccaattatattattttagttatttaaaatgtaccgttaacttatttttgaccatagtcaccctgttgtgctgtaaggtagtaggtcttattcattctttcttactatttttttttgtacccattaacttattttttacaagctccttagttaagtgattttaacatgaaatcaaaggtaagaacctctaatataaagcttaccctaaagcccaccccattcccacagcatacactgtccaccatcatgtcgcttattcaatgattggaataaataacggtatgaatgaatgaatagccctctaggtcactaaatgatggtcatcttgtgctttgctttgatgttcgtcttatctttaatctcccctcgcagacttgagatacttcttacagtccttgttggggttatttctgggccccaccgtgtccgaagggaccacagtgtccaagggagagtatatggtcagtaaatgcttgtcatatgaatgaaaaatttatcatgaatacccgtcccatggcactcatggcagaattgttaatggagtcccacctgttaagaataacttattcttctccaactgactctttttttttttttttttttttttttttttctgagatagagtcttgctctttcacccaggctggagtgcagtggcacaacctcggcttactgcatcctccgccacctggttcaagcagttctcctgcctcagcctcctgagtagctgggactacaggcacccaccaccatgtccagctaatttttgtgtttttagtagagacgggggtttcaccatgttgaccaggctggtcttgaactcctgacctcatgatccgcctgccttggcctcccaaagtgctgggattacaggggtgagccaccatgcccagcctccacctgactgttaaaacattttctttttttgaattgatacgacagactttattgacatcataaaaataggtacgtgagtgtctgatatagtttgggtagttgtccccgcccatatctcatgttgaagtgtaatccccaatggtggggggtgtttcggttgtgggagtggatctctcaaggtgggaggtgtttcggtcatcggagtggatctctcaaggcttggtgctgtcttcatgacagtgagtgagttctcatgagatctggtcatttaaacgcatctcgctctactcctttttccatcattgccatgtaagatgccatgtcctgcttcaccttccgccatgagtgaaagttccttgaggccttcccagaagccaaacagatgagagtgccatgcttcctatacagcctgcagaaccttgagttaactaaacatcttttcttcataaattacccagtctcaggtatttctttatagcagtgcaagagtggcctaacacggtgtcctatatggggactaattgtctccaaggttattgaggtagttcttcagcttatcttaaagtaactgttggctttcatctctggatggtgtgtagtgtgggtgggaagaaccaactaagctccagattagttgatgcatggtgagggagtgaaccttcctcccctccttgcttgaaggtaccccaggccctcactcaggcatgaaggtgcaaactcactctttggcacaattttcaaactcttcatcatcttatactttgtctgcaagtacaaacccctactgaaacttcaccccaggccctttcccaatataaaccttgcttgaccacatgcagctgcccacaattatcactgacttcatttttatgattttctttttcctaaaaaaaaaatgccattgctgtagggaaggggttcacatttgcagaacactgacgtcttggctacttacaactcagccacatttggacttttctattccatttggtcagtctccaactctttcttgattcacctgatattttcagtcagaaatatgcacacgttatgcagttttccctttttcaatttactttctcaccatgaagttcccattgacctctccctgttcactgtactctgtgacatcacacattgtgtttctaccgactcaccctgatgtttttcccctttaccgtagatactccttctgaccacctcctctgatcaatacttcgcattcataataaggtgtattgatgtacatatgcacaaaacatctttcataactactcaacttatccctcctggaaataaaacccaatctcaacagtctttggatatcaataattaatgtagaggaaagcccagcaccccaacgcccctgccagagataaaaataagcgaaatatgcaaattcccgttcagacggggcactattgtaatgtgcaatgaagccatgcctatttaaaacaacaacaaaaaatgaatctggcctatggattgctggaatgttgctggcacaattcttgctgtcctcatgggtggcagacgtttaaaatgtggaagatgaaacatactgttgtgagcattgaacatcgcattacgaacgtgctcatggtacttaataaattgtcaaaaataataagactgctgccaagtctgaaagctataaatagctaaaaaaaaatcagacatgactgctgtggattcttttgaaagataattttcctcgtaagtaatttctatgagcaagagcaatacacagttagatggtaaagtctacattcctggctcctgaaatgaacagcctgtgaattagaatgctcccaaagacgtggtgttaaatagagttgcaactacagggtggccattacattaagtaatttaatgaacactgatactgaggaaataaatcaaatgcaaacaatcaacaccaatcaaggaagctgagcatttcaggcacttaaaatgtattaaatgagtgtttcaatcacagtgggtagtttttcacaaactctcttaatcagctagcatcattctcaacaaagtgcccatgcatgtaaacatggtgaactgcaaaagcccaacacattgacacatggacacttttaggaatggaaattctgcttagggttttcactgataggataaacaacagcagataaattgggaaaggtcagtggaagtcaatgttgtgaaacagaaaagaacattcatattttgcatgtagttaaaaaaataagaatttcaaacatagaataaaatttgaaattgaattccaggcagctaatgcacctcccaaaggtggtttttaatgtatctttgcgtaaaatttccattcatgtataagtcctgataggtgcatctttatttgtatatttattatgtgtacatgttatatgcatatatagttatcagtactataagactgataagtacattctctctatatataagtatatgttgtttattcaaacaggatcatatccaagctcactgcctttgctacttaatcaaatatctatcatgatctttccctatcagcctgtataggtctatggtctattgcattctgctcaaggttttcttttttttaaaaaaagtctttattttattttatttttttgtggagacaggatctcactatgttgcccaggctggtctcaaactcctggccataaataatcctcccacttaggcctcccaaattgctgggagtacaggtatgagctacagcgcctggcctggttggaataatattttactgtatgagtccatcatcacttatgcaactctctgcttgttaggcatttacgttcagtttgagagaggataatttattgcaaacacacacacacacacacacacacacacacacacattccttaaaatgtattattttatttcattctccttcaagtattagcattgcatctttttatagcctgtgaaactagggaagagagaggttaagtaatttgccagaaggcacccagataataaacacataacccttgttttaagcccagatgtccttttaattctgaccctatgcctttaatcactacactgaaggttgagtttttaaccaatgttaaaactttatcagagtcgtgatatatgtgtatacacttcaaaagatgtgtatgtttggaaatattgaagaaatatatgtccttgttttgttttctttctagagaaaaagccaggtacattactgtaatcaaaaggggtttctgaattgtaagagatactatcattgttaacagagagtgaaggtaaatattcccactcatgtaagagtcttatgatattcttattagtagctgcagttggataaattgatatttatacgtgtgtctgtgtgtgtgtgtgtgtgtgtgtttatgtacagtttcctctaggagaaagctttttcatttgaaaacattaggtgagttagaagtgctttgcttgttctttcatttccactctacatcttcacatctttgaagagattttgttctttgtactttcaaagaattttagttgaattgggagaaataaaagtattttgattctttaaactccaagtacttctggaggtttggaaagcatattccaatgttcttccaataatgcctgttataagtgcacttacagtcatggtgctgctgtttaagcttacggtttatgaggagacctgctttccagctgcagcctccctccctccacactcctgagggaggcatcttctgtgttatcctgcccaacagtcagtcctcgttcagcaagaagcagggtatcatgtcctctaatcatggtccgtatagactcgggtcaggtggacccacctcagattcccctgtggcccgtaacccgggcctgtctcatcagagcatcccaacccctgacctcagtgcatggcttggggatgagaacctggttcagccaggctggtgccactccattcagaaattgctgggggccctagcaccttggtttggttggtaggagttgtgatggtgggaacttagagtcgtcatggctccagtgatgggagatcctgcctgagatgaaagaccatccagaggggagtatatctgagatgaagagaggacgtgtccagaggccattgtatcaacactcatgttggatctgtaagacacccttcaatgtttagttgtataagccagtaaactccttctcattacactcctttaatgaagttttagttggattttcttgcacattatctcttagagccgtgagtgatgcagtcttctctcatttagggagttgtatttccatatatcttgccatctttactaaattccttggagaaactttgactttttaatataaaataaatacagtctatcactccattatcccttctagtctaccttctcagtcactgtcaacatttttttttttttaactaaaatggagatttggttatatccctccttccagcaaaaatgttagtggcatgccatttcctgcagaatgaaatccacgtgtttttgtttggcggtcaaggcctttggacatctgctcaacccagccttcaaatctcagtgtctcactcacctgcagtctttgttccagggagatcagagagtccaccctagctcaagatagcatgccctctgcctctagggataacatggtctgcagtgcaacatctagcaggttttacagttgggtatccaagtttggcgtgtgtctctgtaacttcatacttttttgtttttttgagatggagtctccctctgtagcccaggctggagtgcagtggtgcgatctcagctcactgcaatgttcgcctcttgggtcccagttcaagcaattctcctgcctcagcctcccgagtagctgggattacaggcatgtgccaccactcctagctaattattgtatttttagtagagacgggatttcaccatgttggctaggctggtcttgaactcctgacctcgtgatccaccttccttgacctcccaaagtgctgggattacaggcgtgagccaacacacccggcaaacttcatacttttgttcatgcttttggtgtgctgttttctccttcacggatttgtctctcctgctggtctgttttgccacattctggtgtcctttggcaaactgaatacccagttttgttttgttttgttttgttttgttttgttttgtttttcgttctggagtccttagtacctctgacagtatgatatttattatatttgatcagagtaccaattaatattaatattcttcctcgtcctcttgtttgatggtttcttggcagaagctatatcttccctgggatgcagaacattgctgaatcatagtagaaactgataggtgtatgtgaatgaactcacaaataaatgcgtgattgaatgaataatgcactttttaacctctatttctttgtaagcaagtcatgtgggttcatgaatataagcagaaatgatggctttaaattttttttcttatttgcgctttcttgtaggctttcattgctttaatgaaatctggccctgaataccttgccaaatacgttttccttgaggatattgataatggctttttatggttatttaagactccctctaaggccatgtatctgcaccaataattccagttttcatttatctattcattcacttttattaagcactttgtagagtgcagaccctggaccagaccacagcagaccaatgacaagatagcatgccctttgcctctagggataccacggtctgcagtgcaacatctagcaggttttacggttggacctgtttctttattgccctctacacactaataataatacaaataaccttctgtgtgctagagtagtggtaggtgctttgtatgcactcttgatgattctcttaacaactcttagtggtgttagaattctttcttcatgaagcagggcacaaaagctctgagaactaaagacacctgagaataacatctgcagctactcagcagtgaaacaagaatttaaaccaagttgtatttgaagccaaagccactacactgtaattccattccttggtcattccctgccttcatcaggatctccgcttggttttgttgagacacagagtatcttattctcatgtccttattcatagctttaagctctcttaagcctactcaaactatttcagtcaaaatatgcagtttacttttccctctcttttttctaaatgctctttaacttcaatgtcccagctttcttagaggtcctgtatatctgaataatcagaattattgtggttttaagtaacagaaacccagtttacagtagttttaacaaaacaacaaaacccaaatgactgtaggatgtattgaatcatggagctgagatcctcatcatggtggctcacagaatcaaatgcatgactcgtgaagtaagggtgtctaaggctgtacctcaagctttgtgactggaactgatggcttggagtttctgggacattctctcttgccaatatctacttgtttccagctcttagtgggctatagttactcttgctgtagacagacatcctccaagtagccaaggaagagtgagcaggcaattccaacattttatcttttaagcatcatgatctcccctttccccaaaagcaagggattgcaagtaacagaaccccatgccagctccagcataaaaattcctgggaaggactccagttggcttggctttgagctcacccatcacccaaactttgaggctaggaagaagagtgttactatgattggcagctctgtggtaacaccatgggttggaaaagtaattggccaaaaggaaaaggggtgattccaccagaagagagaaaatgagaaaatatgccaggatgcaaaatgttagatgtcacagtcatctatggaggcaagtgtcagactttgtgttagtataactgcggactggatagggagcgtttgtccaggctggtgctgccgcggtctctatcttgtttcctaaactccagtccattgtaggctgggcattgtggctcacgcctataatcccagcactttagatggctgaggcgggcggatcacctgaggtcaggagtttgagaccagcctggccaacatggtgaaaccctgtctctactaaaaatgcctaaaactagccaggtgtggtggcagatgcctataatcccagccgcttgggaggctgagacaggagaatcgcttgaacccaggaagtagaggttgtggtgagtcgagattgcaccattttactccagcctgggcaacaagagtggaactccatctcaaactaacaaactaaaaaaaattctgaccactgtagcattggtcactttcaatcatatcaaggtttagatcagaaatgatatagctactataacaattaaattcagtatgtgaaattgcaactgtcttggaaacgtcagagactcactttcttccccttgtctcccaggatcttgctggacgtgtaatagttacccagccttcaatggattgaggagcaacccaggacagtggacaaagccttggtcttgaatcacgtggtctcttctcttgttcagactttggcagctggtcacatgtgtgatttggaccctattacatcaaccataaaatgattgaagaaccagacatgctgtctttttcacagaagattagggagaggcagttagctcatgaatgagaaaatataatataatttgaacagttctgcagtcattaagatagtggtagtaacagccaatatgcatgttgaatgcttagtctgtatagcctgttgtgccaagctttgtgcaagaattactttattttatctgcaaaacaaccctacaggagtcatagttattatctctgtatcagagatacaaacactagagcatagagaagcaaagatacttgccaaagtcatgtagcaaaaacttgtcaaagctaggattcaaactcagatcctagtccttccccaccaggcaaggctgaattactctacagagagagagtgagtgcgtgcgagagacagagagggagagagaaaattctttcctagctctgccttatttctctggctctgatgataggaaagcagtggccacattgtcataagctccagtcactctccaagatggcagaacattccaacactggttaatggctctgggatcatcccatattgagggacatccatccctttgtgttctgacattgatgttactgtcagttgacagtgagctttatcatcaatcccttcaagtacaaaaggccactgttcagaaactgttattaaaagcagcctctctttttaaaagccgtctctcttttattccttccataataggagccagtgtaccagaagaggctgaccttaagttgcgcctgtttagttaaacaaacaacaaaaaaaaggaaatagaataggttatgtttttaatgtatttaagattggaggcctagaattagaatggaactgggggtgggaggagaggtggaaggcaggataggaaaaaagagaggtggccttggattttctttgcttttggataatgggcatttctagttaaatcaacacagtctatttcacagcctgtctcccggtgatgtatatactctttggacagtgttgtgggctgcctaaagatctcttttagccatgggacatgggtataaataagctttatgtagtcacagctactaagagcaatgtgcgtagagtatattctgaaaggagagggcaggatgctcattgtcatggcggatgaggtcaagagagaagggggaagatccccgagggatgcaaattggggagggttttaccaaacaaacttcctccagggtttttattcacattttaatacactttggggggaggtattttaattttaaaaagatgcatgtgatggaggggtgatttgatatagaggttaagtatgggttttataattgggcttccgagattcaaattcagctctgccatgtatgagtcaaagaagtcacatgcatattatttaacctctttgtgtctgtcttcgcatccatagccacatgcattagctgtgaatattaaatacgtcaacacatgaaaagagcttacaagagcacctggcacacggggagtgctcagagagcatttgctgttattacttgcattgtctgggtgctttctatgtacgaggtactgaaggaacagtggtggatgagacagccacagtctgcctccatgagccgtatgttcatagattaaaataaggcaacaaacataaattgatcattatacattttgagaatgctgtgaagggccctcagttgggattagtccagcccccactcccctccccaccaacctactcaagatcgttaagaaagacttccatgagaaggtagcatatgggcaaagatcaaatgcatgaccagctatgggaccaacacaccaatggaaggaaacagaagatgcataggttttgagagcaggaaaaaaagagacttgtgaccataatcccagcactttgggaggccgaggcagatggatcacgaggtcaggagttcaagaccaggctggccaagatggtgaaaccccgtgtctattaataatacaaaaattagccagacatggttttgggtgcctgtaatcccagctactcgggagactgaggcagagaatagcttgaacccgggaggcagagattgtagtgagccaagatcgtgccactgcactccagcttgggcgacagagggagactccatctcaaaaaaacaaacaaacaaaaaaacaaaaaccagaggagagactggtattttagaggacctgaaagcagccagcataggtagagagtagtgatcaggcagggagtggcccctgtggaggtaaggcatgcaggcaaaggtgagatctagccagggcatccatgccaagtgatgacatgattttaatcttagaatgatgggaaaacactgggaaggttgaagagtgtcctgatcagcttcacattttttttctttttttttttttttattatactttaagttttagggtacgtgtgcacaatgtgcaggttagttacatatgtatacatgtgccatgttggtgtgctgcacccagtaactcgtcgtttaacattaggtatatctccaactgctgtccctccccactccccctaccccacaataggcccacattttaaggttactctggcagtggagcaggaaatggcttgtaggtgcggtagaaaggccaaaaggaggttcttgcagctgactaagcaggaggtgatgttaagttagcccaggcacgtggcagggtgagaacagccccttgcagataaggcatgctggttcagctctgtgttctcttcaccctgcttacctaaccaccttcatctgctgttgcttagttgcttgctttcaccaggctataagagcagggactatctttttttcccttcttctttatacattctgtttctagtcctgtgtcaaactcaggctaggtgctcagtatgtgtttaatggatgaaatatgcagtccactgctcattagaatgtttaattttgcaagcccatattattagaatattaagcgaactacctcatgactaggaaagtcactcctcttgacattgcaatgtttgtgatgcggaggtgggattctagattatctttatgtcaaagaaaatgagcaatgctatggaccttgggcagagcacaggcagtacatggcttggcaatgtattttctgtaggaagatgtccccttagctccttatctgtggtatttcaaccaggagccctagttaattttcatgcaggagaagcctttgaaacccaggcctcttttatgctctgggaagatttgagaggggtcatccctgtttagattggttctctgcaccagtcggggaagcctgccggctgttctcagcatggagtatgttgcagagaggaaacagaccagagaaccagggcacttcccagcttgaatcaggcctgtcttgtgtgggttcattattttgttggaaattaatcccccaaatggcagacatagtatatttgaatgtgaactgaccgtgcattgcttggccaagtgagagtggtttttggattatccaacctggttgattgtccctgtctctgaacccttccattagtgtagataattgaaagatacctgattttgttttttcacacccaatttgatgtccttatggcgtttgagatggggtggggagtgtgagatggtcagaatcagcttgctgtcatttgcaatggaagcggtgaagtttgcaaacagcagtaccacttaatgagagcttgtcatgatatagccattgtgttcagctcttaatcttaatgaccacattcactcctcacaacaaccctacagtaataataacactagcacttatttggcatttactatgtgtcaggtgctgttctaaacactgacaagtattaactaacttaactcacaaaacaaaccccagagagtgagagtcacatggactaggatctgcacagcacccttgatattaaactggggggaagccctgcttgtgacatgggtaccattattattctcctgttacaggaagttcagaggggttaagtcacctgcccaaagtcacacagtcagtgtgtggagggggcaggaactgaactaaggtccttaggtctccaaagtccccttgctttcttttcattgcagcagcctaagaaccaaaagttagatatttattatacatgggtttggggctctttacagtatgatagaaaaatatactgctttgctaaagcctccccctaccccttggaggtagggggagagagagagaaaaagagagagaaaaaaatgagaatagcaatgccagctaaaactctgctcgaagcacagagtttggtgcatcagtacatgtgagttaagggaacaaccaaattacaaattaaatgaatgaaaaaactggacccaaactgatgcttcctcttcatgctgcccctaatgacgtagctggagtcacttcacttcgggacttctcaaagccctgcctctccttgccagagatttacgtccagtctgaggatcgtttaaacttcctcctctgtccaggattctgtgaccttacttacaaggcggctgtctgctttctcctaaattctgtctcctggttccgaactcattatttctgatccaaccaattctgtaatgtcagcctgtgtaacataatggaaaaacaaacttagggtaaaggaactccagcgagaattttaggtctccttgcttgatggaggttcgtggccctgagcatttctaagcatcctcatgttcttctccaacttcccctatgacagtccagtcctccacatggggaagagaatgttttatctgtacctgtctttggttttgcgtccctgcacccatcccgcaacttgatagaaaaggcagagagcccttctgccatttcttctctcaatacgcccccaccctaaacctgaaaagaagaaaggtaaaatgggctattcaatgaggagtctaggtgttgggaagaagaatctatttcgaggatctgaaattggaacctgcatcagaccttaggataaagataattatcatgtgcagaaaattcaattaaaaacaaaacaaaaaagaagaaaaagcatcttccaagttgttcttaaagtgtagttttgcaatgactatcactgaaaagtaagtgtggagatctgttcagttctgtaattgagttgggaagtcgacccgaaggaattccaaaagccccagttggccagaagaacaggatatgataggatgctgttgatctgctttcgtttccatgccaaggtgttttgttttgttttgttttgttttgtttttggtaaacttccattcatgactgtgtacagccagaagccagtaggacaacagtggctttgtaaatttgcaacagatattcaaacaagataagtacataattagcatggagcagcagatgaggtagtgtggaagatttaaattctgcgtagggaattagcaaacagttcctgataaccacattctgaacatgttgctgttcgatgggtgtgaatggatcgtgtaggcacagcccatctagatggctaataatagaagggattgttcaagaacaacaatgtattgtgtgcttaccatgtgacaggtaatatgctagactacttagtgatataatgctttcttcgtaatatctctgtgaggtaggaactattataatccacttttacagataagggtgctgaatctctgattgttgaagggacataaccctgccatctctccttcttgatctatatatgtatctctatctatctctatcatacacacacttacatctctaatgaatggcaaagcttggatttgaatacaggtctcatctaactccaaattctatttctcctagaggaagttcaacatgagggatttcgacaaaaaggttgttaaaagcagtctgattgactttcacctaacagatctttccttcatcatcgccatcattttagctctctgcaaagtcatcacatctgtcactgacgttgcacctactttgacacaagctgtgggctacgcaacttgcatgcatgaactcctggggaactcacagcaaaccttcataggtaggcaccattatcctgatgtctgactcaggtgagaagccagaggctcgttttccaaagtcacatacgtagaggtcctgccaggacccaaatttggtgactctgagtcctacattttgcacttttataaccacacactcttttgttttccaatcaaagcttgatcaatggttgatgatagatagatagatggatagatggatggatggatggatggatagatagataatagttaaaagaaatagatgtgtgtgtgtgtgcatgtgtgtgtgtgtgtgtgtgtgtgtatatatatatatatgtacctatacagaatatatacctgtatccatatctatataaatttggaattcaaaattgtgctgtctttctctttcttctgagtcgtctgaccagcttgctgcatttgcagccgccacagtgcatttaactccttgcttgcattggtattcctctttggagcagccccgtcacaacagcaattggaataaaaccccaaagagtagtgcagagaatataaatgggttatttttcacctcaactcaagtaggacagaactcttataaagaaccagggaacaaaggttccatgacaaacatacaccaggggactttagctctctctgatacagcctgtgtgacataatggaaagacaaacttacgatcaaggaattccagtgagaattttaggttgccttccttgatggaggttcgtgggcctgtgtgtttgtaagcaccctcgtcaatagcatttatcgaatatctactctgtaagtgaggctactggatattgcctgtctgtataggttatcatgcagtgagcctggatccatgtgaactaaacagatgtattcagggagaacgtttatctctctaaataagcaattgtttatcaacaatataaatatctatctacataagtgattgtttttatcaaaatcatgagaatcattaaagagaatttacggcaatgagattggaaataagagctttctggataattaaaagctgatgtgaaattaaatcttttattttcaaaggcagagtagcagagtgcttaaggatatgggattggtaataacccttgctgagtttgaagcttgatcccaaggtcataccatcttgggcaaggtgactatgtattcttaaacttggtttattttctgtggtaggaagacattttaacatctgtgcaaccttcataaacctttgactgatgcaatctagtctctgcgtgaaattccattcaatgggggaaagcaatacaaaatgttaaaactgaacattttttaaattttaaagcattttgaaaaacctcttttaaaattaacataaattaaaacaatatatttctgtcttctgaaaaatatacatgtgaaaggaaattcaattcattatttttagtaacacttctcatgtcctctttcctgccctgttctctgggatttacatggtgcaacaactttttcttggctttccccccatgcccacccccactgtctaccgttgacccattcagattctctccctttatttcccagattattaaaatatatatggttttggccttttttcagtcagtgcttttattccttctcttcttccttccatctctcccaccccttccttttatgtcattcttaaagttcagcatcacatatgtccgcggacctgtttttcagctcagcaggctggggagagagataaacaagaaagaaagtctgtggattagaagggtggtgagaacctggaaacatttccatatcaatactttttggtttaatcaccccatttgctttgacttctacctgtcaacagcacacaatgaagaccaagccacagagcctccattcccaggcatgggaaaactctgtgggtagttgagatgcagcagtacccaggttcacttggggcccttttctccatggtcctgataggacagatgagatgcgaaaggatggctggtattttgctcggccaagaggtgaaagggcacaggacaggaggagagtggaggaaatgcaagttggtgtgaagctgtagctctggtgagaataatgtatgagatgagtgcatgcatggtgattttgactataagacccaagaggacccctcctcatacaaatggatacaggtgggtgccaacaggaggaatgcgctgttcagtgtcctataaggttagcaatcatgtcagttttcaaagtccacagagaagtggtgcctgtggtcaacctggaagtatgacggattggataaagaaaatatgacatatatacatcatggaatactatgcagccgtaaaaaaagaatgagttcatgtcctttgcagggacatggatgaagctggaaaccgtcgttctcaccaactaacacaggaacaaaaaacgaaacaccgcatgttctcactgataagagggagttgaacaatgagaatacatggatacagggaggagaacgtcacacaccggggcctgtacttggtggggtgcaaagggagggagagcgttaggacaaatacctaatgcatgcggggcttaaaacctagatgacacgttgatgggtgcagcaaaccaccatggcacatgtatatctatgtaacctgcacattctgcatgtgtatcccagaacgtaaagttaaataaataagtaaataaataaatggaaaaaatgaaagtaggatcatttccacatagcagtctcttatctgtaacaaatatatatatatgtgtgtatatatatatatatgtatatatatatgtatatatatatatacgtatatatatgtatatgtatatgtgtatatatatgtatatatatatgtgtatatatatatgtatatatatgtgtatatatatatgtatatatatatgtgtgtatatatatatgtatatatatatatgtatatatataaggcagtcagaaagaaaggatggtccaagaaggggaagaggttgggtaagaggactgaggcagaaggaggcaggcatgcccaaggtcacctggaacccctgacccttcgagagcagagttcatccttggagccctgggacagagatgtgaatcagagaagttgatgagaccagattgtatggatttggaaagttagtctaagtctttgaacttgacattggttgcagttgtgaattttgaaaagcgattaaaccgatataatcaatatgtcaacatgtgcttaggacaggtgctggcagtctcagcaccactgacactttagccagaacacttttgctgtgggatgctgccctgtgcattttaggacacttcgtagcatccccggctgccactcatgacatgccagcagtgtcttcctctcccgttttgacaaccaaaaatgtccccagacattgactaatgttccctgggaagaaaatcacctttggttgagaaactctcatttaggaagatactgctaagagcagtatgtgggatggatagaaggcatatgaaaccagaagcaagaggaccccttagaaggctgtagtaaaacttaggtggagaagtcctaataatgtgtgcaccccaaagcgtaaaccttacacctgcattccatgagtagatgtgagatttgtaggaactttgagaaagaagaatgactggttggagtatttagcaggaagcacaggggtcattttttgatgtattttatttattgaatgatttggttacttatttttctttttttaatttcattttaagttccaggatacatgtgcaggacatgcaggtttgttccacaggtaaacatgtgccacagtggtttgctgcacctatgaacccctcacctaggtattaagccctgcatgtgctagctatttatcccgatgctctccctccccatgatgtattttatttttctgaatctattaaaaatggcccctcagccaaaggagcaataaattcactcccagcagggatgttagccaaatctcttttccccattcaaattaaaagacagcatcaacaatatttgatgttgaatttcttcttcttctttttttttaaacttttaagttcaggggcacacgtgcaggtttgttacataggtacacttttgtcctgggggtttgtcgtacagttgattttgttgcccaggtttaaacttactacccattagttatttttcctgatcctctcccacttcccatcctccaccctgaagtagacaccactgtctgttgttcccttctatgtgtccatgtgttctcataattcagttcccatttataagtgagaccatgcggtatttggttttctattcctgcattagttggttaaggacaatggcctccagctccttccatgttcctgaaaaggacatgatcatgttcttttttatggctgcatagtattccataatggatatgcgctacattttcttaatccactctatcattaatgggcatttaggttgtttccatgtcttttctactgtgaatagtgctgcagtgaacatacacatggatgtgtctttatactagaatgatttatattcctttcggtatatccccagtaatgggattgctgagtcagatggtagttctcttttttggtctttgaggaatcgccacactgccttctacaaaggttgaactaatttacactcccaccaacagtgtgtaagcattccctttgtgtccgcatgatgttgagtttcttaataaaattcccatgcccttatcccatcatcttttgtaacgttttatttatttttaaaactccttacaattgtccatttttgtctagggtttactcagttcttcactgccagctggccattaaagacatttggaaagaaaaatgctgatgcaactgtgctcttgtacatattgcataatcaaccaaaatagccccagaagtgattatgcttgaagctacaatgacagcaaagatacactgtcattcaccttgaccccatttgagatcatatcatttactcaagttcattgtgtttctaaaacaacaatttctcttagaatgagtgtgtttttgattgtgtgcccgtgtgtgcacatgagcatgagtgcatgtaccgatgaattttacactctgtttccaaataatcttccatcacaattctgtttatctcactcctctgctcaaaaaccttcagtggctccctattgcttatcagatcaactccagggcagtgtcatactgaataccttccatggcccaaactctgttttcctaatttcatcttgtcctgcaatattttctgcatttcactttttaactaagcaggataattgtttaaatgtttatagtatcaacagggggactatagttaataatcattccattgtagatttaaaaataactaagagagtttagttggattgtttgcaacacaagggatgcatgcttgaagagatggagaccccattttacatgacgtgattattattcatttcatgcctgtatcaaaacatctcatgtaccccataaagatatacagctatctatccacaaaaatgaaaatttaaaaacatttaaatgtttataaaaatgaagaaatgaatcaatgcaattccgagttcatttacaacattagatgactgatacagaataacaagatatagactttcttatgctcactttctaaatcaaaattgttatttgcttctgacagggtattcggtatttaattttactatgtcagacaggaaatctagagctgaacatttcaagtgtgcgtgtttatgaatttttcattaattactctgactgaaattggatacaagcctagcttagaagatcacccattgcttatttactcagattgttatccaggtcacctactatccagtgaaatctatcattattcctttacttttgcttgtttcatttgccacatgctttgctggaggtcttttcagtctccctcctctcctctctagccgttaggcagagttcaataactgatgtcttgaaaaacttcatcaggactcacagcctaagcaagtgaaataagctgccttcttggtcagtggagacagatattttcatgtgtctctgtgtccactttcttcttttaaataaacttgtgcaagaactaggtaaaatatctttcttctttctctctcctcaaactcactttgccttcctgattcacctccatgagttcccttttatagtttctgggacttggggagggtggcccagtagcgacgaaagtgcaagtggattggtgactgaaaaatatctgcgatcatgtacgtagaacaaataaagataaaaacactggggccgggtgcagtggcttatgcctgtaatagcagcactttgggaagccaaggcggatggatcacctgaggtcaggagttcgagaccagcctggcaaacatgctgagacgccatttgtactaaaaatacaaaaaaaagtagccaggcctggtggtgcacacctgtagtcccagctactcaggaggctgaggcaggagaattgcttgaacccgagagatggagggtgctgtgagctgagatcgtgccactgaactctagtcttggtgacagagtgagactgtctcaaaaaaaaaaaaaaaaagctgatgaaaataagtccattcccactttcaaatctctgcacatggcccttttaaaacaattcctttatcttcgtgagaaatggcatttgagttttcgaattctagtaaatagccaccactgtaaatctgcaggctcttgatcctagatagccattgcctctacagaaatctgttgagctgagggaaagttctcccattgaaaataattctgtactttacatgcagcctgtggtccctgacaattgatatattgccgcagaattaaacacgcttttctttgtcattgctgggcagagatgactttggtttatgaatgttccagattactttctacctgcctgtctctgctgagtacagagaagtttcatgacccagtgcctccatctgattccagatgacacatggatgaccccaaaatgttgcagccaggttggaatgaagtgggccagattgggaaggacttgactggattgaaatggagtgggctagactgggatggagtggaacagaatggtagagagaaatcagcccataggttttaattaaaagccattgagaaatggcttttaattaaatatctgtattaagatatatataaagaaggcatggcatgcatccaggccaggcatggtggctcatgcctgtaatcccagcactttgggaggccgaggcaggtggatcacttgaggtcacgagtttgaggccagcctggccaacatggtgaaaccccatctgtactactgataatacaaaaatgagccaggcgtggttgtgcacacctgtaatctcagctactccaggggctgaggcaagagaatcgcttgaacctgggaggcagaggttgcagttaggtgagattgtatgacttccttccagcctgggcaacagtgcaagaccctgtctcaaaaaaaaggaaagaaaaaaagaaaagaaagcatgcactctttgagaaaatgagataatgttgctgagaaggagagtaatgttgattttccctctggacatggacaaaatatatctgtgcatatatattaaaattatgaagactatcttttgcttagagtgctatcatcaacttgtataacttgcaatgtgttaaacctctgcacaagagggagaaattacctggaatatacaattttttaaaaccccacaaattacagtcactttctgcctagggttgtgaacagatgactgcaaggagtttggctttcacattcccagtggatgagagaaaaattggcaattgtttcttcccttccaaaaagcagaaaagtcctggcatatcctcattgtgtgtgtttcaccaaaatcagtgtctttgagtcctggtgttagcctcatctttcagtttttccatcttgaggaaggttgtttttttctctacctagtaccaaaatagtacgtcaaagcaaaagcaacttccaaacaactggctgttccagcctctcccagatgtcagatgatgagtgtgattgttttagtggctcagacatgccctgtgagagttattatgactgtacagcagacaaacagaaacaggctgctgagccatttgctgggtcatccttgtcctgggaatcgagccttctcagccagtccatcaagcttcaccagtttcatctctgtaaatgtccacattatggtgttttctttgcccattggatcagcgaggctgtgagtgacagaaaactcaggaaaacagtggcttttaaaagttaaaagtaggctttcttcagtccaggcatggtggcttagcttctaatcccagcactttgggaggctgaggcaggtggatcacttgagatcaggagttcgagaccagcctggccaacatgatgaaaccccgtctttactaaaaataccaaaaaacaaaacaaaacaaaaacaaaaacaaaaaaaacctagctgggcatggtggcacacatcgataatcccagatacttgggaggctgaggcatgagagttgcttgaacccagagacaaaggatgcagtgagccaagctcacaccatcgtactccagcctgggcaacagagtgaggctctgtctcagaaaaacaaaaaaaaaagaaagaaagatggatattttctttttaaataaggtgaaacgtagagatgacaaagacagaggtgcagagactccttgacttcccttctattgcggtattccaccatccagaactcttggtttctgccttcccatccaagacagtggcttgatttcggccatcataccctcattcagatgggcaggaaagagaatcgggaaagttaagtcacatttcctctctttaagggtacttcctggaagctgcatgtaccaatttcacttacatttcattatcccgaaattagtcacatgggtacctctacctgcaaaggaggcttggaaaaaagtagtagatattatggcggtggggggtggtgagtgtgccctgctgaagaattgagtctcttcttaagaaaaaaaggagagatggggaggaatatgacactgtttgcctcatccatattgagggaggcagtgttcactgcagcagcatctcataaacattggttaaaactatgcgtttgtagttattttgctgtcaactggattgcaacatctttcccaacaattgattgctcacttttattttcccactttcattcggcctggattatgttatgttctgggaagaatcggaacaaagggttgagggctgtgatttattatttaaagtttaggtgggaagaataggaacagagaaagatgtctctgccagctgggattgtgtcttgctcatctttgattttccttgcaacctcagtgctcctttatccaaggaagcgcccattctaagtaccagggtcacagtgggcaacaaggcaggccatctcacaaccctcatggaaataacagatcaaggtaagtaccatcaaggagattaatgggatgaagttgcaaagaggcactgaggccgggagagggcccgctttagatgtggagtagacagggaaggccactttgagatgacatctgatttgtagcctgaaggatgagattaaagtcacccactcaaagaaccagggagagagctgtaatgtgcccaagactgaaatggggaaaagtttggtgtgtttaggagaacacagagtgcgcctgtgggttgaaatgggttgaaatgagaaagagatgccttatatagagaagatgtcttatggttctgctcaatattggagggtcatactttctgcttccccaggaattttgtttgaaatccatttgtgtagaagttcttagtcaccccagtcttagctggaatcattctagcatagaattgaatttgagcattgagaattcatgctcaaactgtggggccggtgtgggatggcaaggagaatgatatctatgttttcacgggagggtataaagagagaggctctgataaacacattcaattggttgggggaaaaaagtaaacttatttggaggtacatttctggaatcgcctgatttgaactgagcagtgcagcctccatttatgaaaccatttctctgaatgtttcttttttccaatctgtcttccattctgacagatgtggcatatcttgtgcccaattcaacaagaactagtctccctcccttcctgtctctctctctccttccttggagcttagagcttctgctagtgtctgctcctttcctagttggcatggtagttgctccatttgtttttgtaaattgaggaattttctttttgtttgtaaatttgtcattatctcctacaaagcaccctgccatggttttttaaatatcttgatgtcttcacattggaagcaccactccatctgtgaactagatgcttccatcccaaaatgccattccaaaggagaaagttggaaccaaaagtgttggtagcagtggccaccaccagcaacatccactattacaggattaataggaattaaatctgcttcagctgtgaagtgagccaaagctttacttgcaagtggggctaaaacatttttttttaaggatttaccttaggtaaattgttctagactattttgactttaatttgctgagggtgaatttgcaatggggattcgataaccttactttcatagagtctcaaaacttatagttacacaacttcttctactgcctgcccattgctttgggttccttttcttgcaagttgcaatttgtttggtttttcagtgttctcttggataatccatctggatcactttgactaccaattttgcagcttcctgtcatgaaaggagaaaaactgaggtccaaggaagtatgcaaccgtttccataaccatgccatatccctgcatgaacttggcttgactttctcccagtgaagttgcactgggtatgcagtgggctccagagtcatcaaagtggctgttgcccttaaatagtcattgcattatactgttctcttgttggaaacccgtcaaatagtcttaaactgaagttcaaatgctcccactggctggtaggacagtgagtgatcagattgcatcaggcccatcggttctcattgcttaccattcacctcctcgctcacatcactacagccacagggcccttctctgcagacctcagacccaccacattctcttcctcttcaggaccttttgctcatactctccccaccgctaatgtgctcttccccttccttgtcttcagtaatccggatcactggatagaagccacaccccttggaaagcagtccctgaggcctaagtgccaggcaggtgctcagctcttttttgcagcctatgttgtcttttcttagcatgccactgaaacttctaactatctgattagtttttttgttttatttctgtcttgctcaggaaatttcttttccttgattacctctgagtccatggcatatgacctaacatgtagtaaatgtgcagtgagcattggttgaataattgagcgaaggaactccgagttctgtgtgtgggaaccgactctgataagagcaaacgcttgacacccaacctcgtcctgcctcccatgccgcatcaccctatttccaatattgtgggtggggctgatggttcaaagatgtacttcattccatttcctttttccctacaagccattcaacaaccataacggagacagttatctggggctattttctagatgttagacacgaggaaacctgaaaggaacattatgctcttcgcacactcacgtgtttgtctggttaccctcgggcctctccaagtggccctattttttttttgacattttgtttttttgtttgtttgtttggggtttttgtgagacagaatcttgctttgtcacctaggctggagtgcagtggtgcagtctcggctcactacaacctctgcctcccaagttcaagtgattctcctgcctcagcctcccgagtagctgggattacaggtgagcaccaccgtgcccagctaatttttgtatttgtagtagagacggggtttcaccatgttggccaggctggtctcaaactcctgacctcaagtgatccacccacctcggcctcccagagtgctgggattacaggtatgagccactgtgcccggccagtttgacattttgcatagcttacaacatttattaaacatttaaagacctgaagccttcttaaattagtgtttctcaagcccttcttgtgcaggatatgtgcgtcaaccaccaaattagctttggtgcacccagcgtgggaaaaggagcttttctttaccatgttagctctctcaactgccttccttgtacttttagcttcagcctttttgaaccaactactctgaattcttcagaatccctctgtctctcttccttctgccccctcttctgcccagattcttcttgctccctctcctcctcacttcttgtacatttgaaaaccctgtcttcctagaagagtcataccactttctcttcacatgcagcatccttcctggtattgtgggtccatggtaggtttattattccttactaaacattctggcttctctttttgtggtatttcttactgcaggaggatttttacatccccatcaggaatggccatacatcttacttcagctaatgaaacgtgggggaagtgagatgtgtcacttctgggcggaagctttaagagcctctatctgactcaacttattctcttctcccactgtggagagatcagtgagtcacttctctatcagcctggacccttgagagaagatgacatgtagcaaagccatagctaaaagacagccaacacatagcctagtgagaaataaatcttcactgctgcaagctaccaaaagtctgaggtcagttgttactgcagcgtctagcccatcctgaatgatattccgttgtgtctcagaagccatttctttgtaaaaccttccaagtctctagcagaatctcagaatctaagagtcttagaatctatttactaacaggccagacacaattgctcacgcctgtaatcccagccttttgggtggcctaggcaggcagatcacttgaggtcaggagttcgagaccagcctggccaacatggtgaaaccccatctctactaaagatacaaaaatcagtcagtcatggtggcacgcgcctgtaatcccagctactcagggggctgaggcaggagagtcccttgaacccaggaggcgaaggttgcagtgagctgagatcgcgccattgcactccagcctgggtgacagtgcaagactctgtctaaaaaaaaaaaaaagaagaagaagaagaagaatctatttaataacagaatcctagaagaaccttagaatgttagaatccttaaagtctgttgcttttatcatgtgttcccatggcattccctcataattagtttttttgtctgtcttctgtatgacattcagttctgtgcaggcaggaagcttgattgattcgcttctgaattccatactcttagcagagtgccttatgattggcattcagtaaatcactgtgactgaaagcaaatggagcagtgcaaagagatttctggctccaccaccatcatgaatatttttgatgggataggttctagtgaaaagcggtatccacctctatggaaacatggtggtgtttgaagagttccccacagccacacaaaatggaggcacccacttggaactgaattgattatttatggcaaactctggatcccagtcaggaatctgaaaaagggggaaaaaaatctggggcagtgatcaaaggaaaagtatttggagtatatgggcagaaaaaaaactgtcagagatattaatttaaattcacaattcatacactaacaccgtaggatcatgtttcttaggtcaatgaactctactcatattatttggtgatttgtttgacctctcctgataaaccccgatttcactatctcctatgtgtccctcctcttctgttccttataggacttgaggggtgtccccttggcttcttatctctttctctgtagcctaagagaaatagaccatggatatatccagttgcaatggaatccagttgattcctttgtgaaaacgagcaacagtcctttctttagcagagaagctagagtcttatctgacagatttctttttttaccataagtttttctgaaggtatgggtggaagactgcaaaaccctgaacatcaacaagcttcagtgttgcagatactaggagagatctactcctaaaaccaacaatcaaaacttctgtttttttccctttttcccatgaaagagtcaactgaattcgggtacaagtcgcttagatttaccaagtatgataaccaggtgtgtggctattctgagcatccatagctgaaacccacaggttggacatcctgtgacagtttcttagcctgcaaagaacagtgagcatgaaagctttaaatgggctattacctttttatatttatcccaaactgctaaggtcagcattaaaatttgaccttttccctgccaacccgtttgaagtaattaacccctgtgtcttgaaacacaaggaagctatgactttgttattaaattctcataaagagcctattaatattaaaattgcttcactcttgggctgaatgtattaatggccttgcactgggtaaacacaaaccctcagctcagtgttttaaaatgcatgagttgagggcagagcatgttcttccagctaccttttctgtagcagaacgttatgccttttgtgacagtttcctctccaatttgttcaaatgcttttgttttgaatctgtgtccctagatttacatctctttatggggaaactcatttccctgctagcaggtatggagcaggtcgaatggaggagaactcccgtgatgacctctgctcccatcaccctaatcatcgccttccaggacagtgctcagaccctaactgtcttggtatgaagcacagcttgtgattattcttttagtgggtccaagatagctgtgttcaagcacctgtgaaatgtgcttaaaaatgcagaggtacgcaatccagcatagacctcctgaatcagaattgacagagatgagaccttcctgaatctgcagtataaattaaattctcaagggtttactctagtaaaccctactgtgaacctgactatagttcagtttgttaattcaatcattcaaaatatgcatcgaacagttattatatgccagggtttatggccttgggaatacagtggaaaattgaaagagtcaggtgtttgttcttagggatcttacagttcatcgaagaaacacacaacacacaaacatgcaagtaaataattaaaaatagttataagtggacttctggaaagatgaagtaaacattttttccctgttcctccaacagagaacaaacaaaatgcctaaacagaagtgcagtcttcccgcagtatcagtgggggactggttccaggacagtccaaaatccatggatgttcaagttcctgatataaaatggcatagtgtttgcatataacctaaaaacatcctcctgtatgctttgtggggacatatctctcacttcaagcatttatcattttatttgtgtcatctgatatactttaaaacatctttacattacttataatacctaacataatataaatgctacgtaagctatgtcagcaagagggacaacaacaataagcattagtatgacagatttctcttctctgctgttttcaaaattatgctgtatgcttaagcaaaaattatactgtctgatgtgattggtgaatatgtaagtagtaaatagttgttatactgtcatttaatttgtattatttttattgtattgttatttatttttaaatttttggaatatttttgatgtgtggttggtagcatctgtggatatagaacccatggatatagagggctgactggatatagtttcaaatcactgagtaaatcccaagtcagattaactgaaggaaatccacaccaagtcacatgatagtcaaacttctgaaaagtcaaggcaacgaaaacatcttggaagtaacgagagtaaaatgcacgccatccttataggaggaaacccatttgaaagagaacagatttctcatcagaagccacagagtcaaataagaaatggtgttttccaagtgctgaaagaaaatacttgtcaactcagaattctgtattgagtgaaaatctccttcggagatgaaggagaaatcaagacattttcagatgaagaaaaactaaaagaattggttggcagctggtctaccttaaaagaatggctgaaagaaattttctaaacagaaaggaaaggataaaagcaggaattttagaacatcagcaaggaggaaaacaaaaatagccattaatatgataaattttccttctctggtgttttcaaaattatgctttatctttaagcaaaaattataataccatctgatgtgattcaaaatacaagtagtaggaagatttaagacaattatattttaaatggggagaggaagggaacataaagggagttaagatttccacacttcattcaaactggtgaaaacatagcaccaggctgtgacaagttatgtatgtatattgcactacctagataactgctaaaaaaatctgtaaaaggagattcactcaaacagactataggcaaattaaaatttaattatgaaaatatttcagcaacctagagaaaggcagaaaaggcaaactgaaaaacacaacagaaagaacaaataaaaaaaaaagaataaagtggcaaaattaagcactaacataccaataattacattaaatggcaatggcctatatacaccctttgtaagagattgttagagtggattaaagtatacaacctaactatatgctgttgacaagaaactcctttcaaatttaatagtataggtagactgaaagtaaaaggatggaaaaaagatagagtatggaaacatcaatcaaaagaaagtaggagtagctatattatcagataaagtagatttaagagcaaaaaaaaaaaaaaacaactagaaatagagacgatatgtaatgatacagtgatacagtgtcagtccaacaagaatagcattcctaaatgtgcactcattaaacacagagctacacaatatatgaagaaagaaatatataactcaaaggagaaatggaagaatatcacaattatagtcagaggctaaacactattaggaattaataggaaaactagactgaaaatcagaaggataaagaacaatgcaaccattatccatcaacgaggactaatcaacattatagaacactcccaatgacagcagaaggcgtttctttttcatgtccatgggagatatcctgggccataaaacaaagtttaacaaatttaaaataattgaaatgatacagtgaccacaatggaattgagttataaattaataccagaaagataacaggagaatctgcaaacatttggccactagacagcacattgccgaataaattccatggattaaagaaggagtctccaggaaaataaataagtgtattgggcagaatgaatgtggaaatacatcacaatttgtgggacacagctaaagtaatactgagaggaaatttatagcaataaatgaatacattagagaagaggaaaagcttcaaatcactaatctaaactcccaccttaagaacatagaaaaagaggccgggtgtggtggctcacacttgcaatcccagcactttgggaggccgaggtgggcagatcactagaggtcaggagtttgagaccagtctggccaacatggtgaaaccccatacctactaaaaatacaaaaattagccgagcatagtggcacatgtgtgtagtcccagctactggggaggttgagacaggagaatcatttgaatccaggaggtggaggttgcagtgagtcgagagtgaccactgcacttcagctggagcgacagagcaagaccctgtctaaaaaacaaacaaaacaaacagggaaggaagttataaagatgagagcagaaatcgatgaaattcaaaacagtaaaacaatagaggaaaatcagtacaaagaagaagctggctttttgaacagatgagtaagacaaacctcctgacaaatctgagcaaaactgatagagagatgacacaaattatcaaacagggaatatcactacagactttgcagatgtcaaaaaggtagtaagggaataccgtaaataactccacaaacttatctttgacaacttagatgaaatggaccacttccttgtaaaatacaaaccatcatattttactcactgtgaaatggataatttgaatgtcctataactgttaaagaaattgggtttttaagtttaaacctcctaaaaaataaatctccagatcaggaggtttttgttagagaattctaccagatttagaatgaagcattaacaccaagtccatatatcctcttccagaaaacaggagagaaataagaacttctcaattcattttataaagctagaattaccctgacagtgaaacaggacaaagccaggagaaaaaagaaaagaaaactgtagactaatattcttgatcaccattgactgtaacaaaatattaacaaatagaattcaacaatatataataataattttataccttgatcacatagggtttatttcggggatgttaacactggttcaatatttacaattaaatcaatgtaatctaccctaccaataggctgaagagaaaaatcattcaccgaatcttatcaatctatgtagaaacatacttgataaaattcaacacccattcatggcaaaaactgtcagaaaaacaggaataaagagaattgaatttgttaaagaacacctaccaaacacctacagctgacatgctgataccacaattaaaaatgcaatgtcatgtacaatgactcaaaaaatatacttaggtgaaattttaaccaaatacaacttatatgtgaaaaactgcaaaactttttaaaaatttaaggggagacatcattttcatggattggaaggctcatcatagtaaagacattgattctccccaaatggataaacagatttaatagaatttctgtaaaaatcccggtaagcttttttgtggatagagacaacactattctaaaatataaatgaaagtgccatgaaatttaaaaagcttaacaattttgtaaatgaagtataaagtgggagaaatgagtctgttcaaaaacaaaacttcttatatagctacagtaatccggtgtggcaatggcagatggatagacacatagatccattttaaaaagtgtatagaacccagaaatagacctacataagtatgtccaactgatttttgacaaaggtgaaaaggcaattcaatagaggaaagataacctttcaacatatggtactagagaaactgggaattcttgaccaaaattttacattttatacaaaaaaggctcaaaatggatcattaactttgatataaaacataaaactataaaacatttagtaaagaaaaaagaggcccgttacattggctcatgcctgtaatcccagcactttgggaggctgaggcaggtgagtcacccgaggtcaggagttcaagaccagcctggccaacatggtgaaaccccttctctactaaaaatacaaaaattagccaggcatggtggcttcagcctgtaatcctagttactcgggaggctgaggcaggagaatggcttgaacctggaggcagaggttgcagtgagccatgatcatgccactgtactccagcctgggcagcagagtgagactctgttttaaaaaaaaacaaaacaaaccaaagcaaagaaaacagaaaatctttgagatttaaagctaggcaaagagtttgttgttgttggtttttttttttttttttttttttggcaaagtttcactgttgttgcccaggctggagtgcaatgacaaaatctagactcactgcaacctctgcctcctagcttccagcgattctcctgcctcagcctcctgagtagctgggattacaggtacatgtcaccatgtccagctaatttttttgtatttttagtagagatgggcttctccatgttggtcaggctggtctggaacttctgacctcaggtgatccgcccgcctcggccccccaaagtgctgggcttataggcgtgagccaccatgcttggcctagagttcttagaattagcaccaaaagcacagttcataaagaaaagaaaatgataaattggacttcatcaaaaaaattttttaaatcttgctcggcaaaacaccctgctaagtggatgtaaagggaagcttcagacttagaggaaacttttgcaagccatgtatctgacaaaggaccaaaatctagaatatatgaggaactctcaaaactgaaccaaaaaaatcaagcagtgagcaaaggacatgaagagacattttactgaagaggatacacagatggcaagtaagcacatgaaaagatggtctacatcattaaccattaaggaaatgaaaattaaaactgcagtgtggtatcagtgcacacctatcagaagggctaaaactaaaacagtggcaaccccagtacttgcaaggttgttgagcattcggattacatacacatcgctggagaggatgtcaaatgatacattcccatagccactttgagatatagtggagcagtttctttaaatgtaaacacgcagttatcagataacctagtaattgccttcctgggcatttattccagagacatggaaacatgttcacacaaaacctgttcaccaatgtttgtagcagctttattcataatagatagaaactgggaacagcctacatatatttcactgggcgaatggctacagaaattgtggtatatccataccacaaaatacaacccagtaacaaaaaggagtggactgttgataaatgcatgcaacagcccaacagcctgaatgaatctccagaaaattatgccgcatgaaaaattccaatttatgtaaaattcttgagatgacaaaataatggaaatggagaacagattagtcattgccaggggttgagaggagacagggaggaggaaggaaatgggtgtggttatgaaagggcaacatgaaggatctttgtgcaaatggaaaagttctgtatcttgactgtattagcgctatcatcacgcaatcccctgatatcatactatggttttgaaatcacccttgtgggaggaactaggtaactacacaggatctctgtaacattattgcctacaaattcatatgaatctagaattatctcagaatgaaatatctaatttaaaagggacatttatgatgttaataaaactaagtgctattcagagaatgagcagaaggaggacagttgaactttcctacataggctgttctttttaagaagaagagttggtcattgatccattaatgatgagaaggaaccagttctgtctagtggaaaagcattctggacaacagagtgagacactgataccgtgtgctgtgaaaacttttagctgagatatgtcgctcttgtccggagagtgacatggaaatatccagtcttgcttctacagagagtcacattgtctggtcacacctatcccactgcaagacaatgtaagtgtgtgtacatacctacatctctgagattattttatctgcaagcttcagggcttgcaaagttagtatatagctgagcatggtggcgggcgcctgtagtcccagctactcgggaggctgaggcaggagaagggtgtgaacccaggaggtggagcttgcagtgagccgagatcatgccattgcacttcagcctgggcgacagagtgagactccatctcaaaaaaaaaaagaaaaagaaagaaaagaaaagttagcatctttcaatcagcaaacatttattgaacactcactgtaataacaactggtggtatttctgcagtgcttgactgctttcagaatgttttcacacacctgatctcattcgcatctcataactaccccgtggaatagtaattattaacacctttattttcatttcacatctgagggcactgagactgaaaaaatggtatgttgttgtgtttgaatgtgcttgatatggtagacatgggggagtcacatctgtacatatagtcctaaagtctatatttatttccattgtgtactgatgatagtactacattatttgatataataatggaagggacatacctatttttaaaaaacactactttggaggaattaacagtttactaaggatacataaatgccatagaaaatattagcaagaaatagaagaaagtgattattttgtctgccaattagtatgataaaggtaactgaccttgtgaaataaagaaggaacaatataataatatttaccaaatattttaaacaattttgtcatcaccatttaccaaataaccctaatacttccctccccagttgatacgtgatggcaagccagggtgagtttttgtatattgcattgccttaattcattgattgatgctggtactgcaggtgttggattattataagtttaagctattctttaattgtacagatagtaagtcttctctcattggaggggatggatatgaagggatttaacatttttttaaaatttaaaacatcatttctcattaaataaatacctttttcttttttcctgcagtgaagaaaaacatagataaacggatgactcaaagtggaagggaacaagtgattttgttacagtcgtcagaactgtggccagaatcattttagataaatatgtcaaatgtgtggaatgtcacggaagtggtcgttttttgtcctcccagcttggggcacatgctcatagaaatatgtgttagttattgagagtctttttttttgttaagacagtcccattctgttgcccaagctggagtgcagtggcacgatcttggctcactaccacctctgcctcctgggttcattcaagtggttctggtgccacagcctcccaagtagctgggattacaggagtgtgccaccatgcccagcgaatattttttgtattttttagtagaaatggggttttaccgtgttggccaggttggtctggaactgctgacttcaagtgatccttccaccttggcctccaaaagtgctgggattacaggcatgagcctccgcgcccggctgagagtcgttttttaatgttggattcatatttatcccacacattgactggttatgcagatactggtcgcattaagttcccaagaagttctcctctctgctgctattctttatcacagcatcctgtttatctgtttccccacgtgtattacagtctgtaattatttcttttctttgcttttttttttttattaactatgctccttccaggaatgaaatctccatgaagacaaggaccatgctcattttattttgtgctttatattcggtacttagatcagcgcttgccacaggacaagtggtcagtaaccatttgtgaaatgaatttgatttaaataaatgtacatttccagaagaaatgggaaatagacctacctggttaaatgagtgtttttatcttaaccggacatgggttatcactttgtaaactaaaaacaatcccatctcagtactgtaccagacacaattgccggaggttcagaaaataattaaagttttgtaatgacttataaattgcattattaaaaagtcaattttcagctgggcacagtggctcacacctgtaatcccagcactttgagtggccaaggcaggcagataacttcaccctaggagtttgagaccagcctgggcaacatggtgaaaccccatctctaccaaaaatacgaaacttagccaggtgtgatggtgtggttctgtagtcccacctactcaggaggctaaggtgggaggattgaatatgggaggctgaggcagcattgaaccgtgatcgcagcgctgcaccccagagagagtgacagaacaagagtctgtctcccaaaaaaaaaaaaaaaaaaaacctcaatttttatcaggacacagaggctcacaccttttatctcagcactttgagaggctaaggcagaaggatcgcttgagcccaggagttggagatcagcctgggcaatagagtgaggtcgaggctgcagtgagccgtgattgcaccacggcaacccagcctgggctacagagaaagaccttgtctcaaaaaaaaaaaaaaaaaaaaatgtccattttccaaatccgtgctgactccttggatcccgaccgctgtatataactgctggtttcccctacatttaatgtgcggtacagagaagaggggtggcaatgaagacgtgtgctagagacatacaagattctgattgcgattaggattactttagaaacttttgatctgctgggattgagtcatgattctgtaaagcccttgaagaaatacggttaccctcgtgtaagctgtctttcacagctcacttttacttggcccggagtttaattccaagtaatcattgggtaggtgatgaggttccgcttctccttgagctgaacgaattaaaatgtgaagttcccttactttgtaagtgggtaggagttcattggacataggccattagtcacttaatttttatgccatataaatggggcatctctttgccattttgcatgaagggactttgtggaaagccataaagaggggcagtaaatgtgcaggcaggtactttgtgaccacgttgcccctttcggctcagtccccttttgagggatgattcgttgcaggcaatttcctgccctagtggcagggagcaggcatgtgctttaaaatccttccttttaagaatgattccttgccctgcaaggttccttcaagttatttttttttttcgtctccaactgggggaaattgtaggactcaccaaaaaaaaaaaaaaaaaaaaaaaaaaaaaaaaaaatagaggcacaacacaagaagagtattacctaatcgcatgaagcataaatctgtgcgtcacctcctactttaataaattgctctttagtttcagaattggtgaatctaagtgggcacccaaagaagaaaaaaataacaattttccccttatctctgaatttctcttttgagctttttcgtagattatcgtgggtctctacaaagatttccttttccttctatttttaggttgttaaaaaaaagtcatactgtgtacttttttctcataatcctttatttgttatttaaagtataaataaatcatagatatttgcatacagcttagagcagagtaggtggggggttattttggtttatatcagagaaaatggaaataaaatagaaactcgatattgtttaaagacagcttaacagcattgtaaggttcataaaagcccaataagctattcttgatcttaaatcttaaatcgttggtgattttcatttagattttttttaatcaccaagaaggttgagatatgtctaacccgttatgtgagtttgaaacaaggtttgtgttctattttccattcctttggtctaaaattttattagacatttttcttagtgcaaaattaattgatcctggtggtgaggtggtgataaatcattgcaggtggggggaaattgatttttataccacctctcacttatttcaatcttagtggaattaactctgttaggttctgggggtgtttatgggtattataaaacatttacatcttgatgtattaaggtacttgagtggtttttagacattattaagggaattatgttaggattagtctggttatcaatttctgtatctggcacctagctaaggaaatggctgttttatcctcattagagccataaatagaattttattaactagcacgtaccaagtgccaaggctggtggtgaaaaccctttctgccttgaaggggagactgtagattcctgagcatgagacgttaaatgagtaagtctttgacaatctgtaaacagcttcctctgcagaagagtgccctgttgccttggagtttgaaaatactgcaggggataaagattccatggaaactttaaacaattgggactgatggatttaatccctctgatacgcttgtgtaagtctcactgaatacagatctgattatctattggccttggagaaggaacactgagactgtccatatggaagattattagggagaagagaaacataaacacactattaactattaaccatgctgtatatttgatctttactgaggctgttgatgtcagggcttggttttatttatctgaattttcttttgccatcaagattagttttaataggcttagacaaaacctggctgaaagattataaacaaaagataatgataaatggtaatgttcccacttggctgggatctggggagagaggaagggagattcataatagcttggtctaggtgaggattttttttttaatgatctggaagggaaagtaaattgcatgctaatgaaatttgcagacgatattaaattggaaggtgttgcaaataggagcgtggactggggacattacagaagcctatcctaagcaggttagaaatatgagcagaaaagattaaaacacgattcatcctagaaaagacagactaatacattttgggggtcgggaaagggggataccctgaatcttgcaatggaactgatgggaaaactcagaaggaaaaatagggaccagaggtagaggaagctacaggcagtctgcagggtggcattgtccaaagactctctgttggtccgtggcctgagtgggataagctgcatcgtcccagaatccaaggacagccgcctccctccgtcctcgcttctcacaacttctggggctgcctttctgctgtctctgtctttgttttcctctctcttcctttttttgttctttcatatctatcagctcacccacccctagtctgtagcatttatttctggtacctttagtaggagaaagatggagacagattggagacaagttggcaatgaagagtgaaaaagattaagggaaggggaggattgatacatgaggagggattaaaagcattgcatttgcatcatgcgtccacacagcatccagaggaggacataagcacacaggcacttagacaatgtaatgtcgcagtactcaggaaggtggccgtggcattatttagccccacgagccagaatatagccagaagtaattaagatagggaaattatataaccaaaattcattgcgggagagaatgagggttggaaacatcacggtttatgtgtttataccggtcattacataaaccagtcacatctgaagggctcacagctacactgaacaggggcttgcttaccaacagaaaatcccgaggacacatactacagagagtatgtggctatttccttttcctttgagattttttgttaatatatatgtctaggagcgtgctcagtctaacatctccaaagcagatctgcatgctagcaatgctagcaacatatgtgtgtgtgtgtgtatgtgtgtgtatatatatgtgtgtgtgtatatatgtatatatatatgtattacatatgtatgtatatgctatcaacatgcaggtctgctttggagatgttagactgagcaccctcctagacatctatgtccagtggaaagagcagtggagagcattgggctaacatgtattgagcagatggtgggggatgttagtaatgagatataaattgatactgtgcagccaactttcagaggtgcttactccatgcccggtgctaggacaagcaccttgcagatgtgatcccacggaattgtcaccataaccttcagagatgggcactgttattgatcccatttttcagaggaggaagatgcatctcagagagattatgcacaccgggaagtgttactctgcatagaagtaggggacagccaggattttccacaccaactccggagcccacgccttgtaataccacgttttgctggtgaatccctaattcagaaaattaccatgaatgtgtcatgggagaaaacagcttccaccgagggtgtgggccccaaagtgctttgttctggaattcattgcaggggagaggaagagacttcagggtaaaagaaacaggtgaggtgtggggacctttgcattattttgtgggagaacaccgagtaaaaaatagtggcggtggtgttggtagtaacggcaaaaacctcagttacttttgtgccgacgtaataacaacactattcataacattaacagttgaattttcagagcatttgctgagtgctgtggataatgttggtgctttctaagcatttttcacagactcctcttagaaagcctccaaggaaagtgaagattaggaggatgaagtaacttgcccaaaatcccgctgccactctgacttgatccaggttggaacccaggcaatttgacaaggctaccccactgcccgcctgagttgaatagagagaaaagtggaagaaaattaggccgtactgcacaccagagagacagaaacgggtgagcgtttgttattgggcaaaataaaaatgtaccactctatagagtggtatcatattaactgttcctgagtagagaaagaatattatctctgtaccatgagaagtaagagttctgaattaaaggtatcacctctaagttttaatttttgcagaagctctcttcatctgaattcacaagtattgactgtttcttgggaaaaatcccagattgcgcatagaccagcatgcttgatctctgagacagatggacatgctgtaatcttaaagtgaaaaatctaaggaaaattttacaaggtaatttttgtctccttttctgaacagcaagtttgacacctagctatggcttcagggccttctcattccttgtaccttgtctgttttttttttttttttttttttaattttactttaagttctgggatacgtgttcagagagagtgtgcaagtttgttacacagataaacatgtgccatggtggtttgctgcacctgtcaacctgtcatctaggtgttaagccctgcatgcattaggtatttgtcctaatgctctcccgcccattgcccaccacccccgacaggccccagtgtgtgatattcccctccctgtgtccgtgtgttcttattgttcaattcccacttatgagtgagaacatgtggtgtttcgttttctgttcctgtgttagtttgctgagaatgatggtttccagcttcatccatgtccctccaaaggacaggaactcattcctttttatactttgccccttcttttaagaggtctttaaacaatctcttagcttcctatcagcctgtaagtcttcagaaccaaggagagcaagctctgcacatcaacaaggtctaataatttcttgagcatttgttatttgccaactacttcattaagtactttgcatctattgtctcatttcattgatccttacaacctactcagttcatagttaagagaaccctcacttgaagagatgaagaactctgtgtaccattgtcaccctgttgcaaagtgactgagtctagatgtgctcctacatctgactctaaaacccttacgcaaccaaacatggtggcccctgcctgtaatcccagcccttggggaggccaaggcaggaggatcacttgagctcaggagtgggagactagtctgggtaacatagtgagactctgtctctacaaaaaagtgaaaaattagttgggcttggtgactgaggcctgtattcccagctacttgggaggctgaggtgggaggatcgcttgaaccccggaggttgagcctacagtgagctgtgatggcactctgtacccaacctggattacagagcaagacctcatctcaaaaaacaaaaacaaacaaataaaaattaaataatatccttaagcctagccattctttcctactacagtgaatgggctaaatttttatttattctgtttttatcccagtccttctcaagcagattctgccattgaagtggaaacattaacaatcagaggcctgttttcttggtgttatggcactggttgaacttcacgtagtatacataggtattacccagcctcaaaaacaagcaaaaattaaaaattctctccagaactcaggtgagtgaaaaatgggaaaggatgcctaactttatagatattgcaccagttcatccctttgtccctacgtgccgttagtatagtgacggagtttcacgttggcacccagagatccttccagaaggaatatgcacatacccgcagctacttttgtttttctttctttctttgcagtactctaattagaaattgtatatctgggaagtcctctgtggtttgacagtgagtggcagagatatggccaaattacctgcaatggcacttttaatttattttctactcctggcttgcctcacgctaaaccgactttgtttctgaagctgttcttatttggagggaacaagaaaaggaaggttttccaagtacaggagtgcaatgcagaaagttcctttttcgtgttgatcttagtgagctgtggatggtgctggaatggatggagagaaagggctttgcctgtgtagcttgtttttaacattattccataaagagcactgacaattaattagactcacacaacatctaggccattggtactgaagtggtagatggtaatcactttgccccatttttcctattatctacttagcagctacaaaatataattctgcttgcaatttatattctttttcatgctttggctttgctattggtactgaaattaaccagtttgctcgatctcttttcctatgccgtcaggacagctctggggtagttcagaaatcaattttcaatcagttcacacctgtacctaaaccaaatcccaatgatgcttgctggtaagctgccgatatttgaaagagtcactgtgctaatgaggccctcacatataatatctgcataaatggaagatgtcattcacaaccagtgttgaggacagcagcctgcagaactgcaggtgggtgggctgcgaagttgggataaatgtttcattcatttaatgccatttttatcacctgtttgcctgaggaagacgccatagcaacaatattttatagctttaaatacggtgttgatgttttctggagtcaggaaaagttgggtatacttacagaaagtggagaggtccttggtttctttcatgccactttgtaaagatgaacaactattcaatcacggtgcagaatacccctgaccttgtgaaatcaggggagaatggaaattattttcccttctcagtcattggtattcagctaggtggtttatgctaggttgtcttagaggtattgtgactccgttcacattatatacgagtgcatggagaacacattgttcttctcattaaaggcttattaactgcagtttgtgaaatggagtgaaaacaaatacgcttccaaatggctggcatgtttcttatcctcttgcctgacacagaaaaccccagggtatcggggaaattcacaggaacaagggcttcaaagaaacattcacagttagccagtcttaaaccgagagaggcaaggaaatcgcaggaatgttgatttcttcgttgttgtttcttttcagatacttactgtaggagtcaagaaaaatgaaaattaaaaataatggctaaaagtatggaagaatctgctcagtggccctggataggggagaaaagggggtcccgttaatttgcaaatttggaattccagatactaaatatgttaagcttagtaggaagtagattctgcataagcctccatgacaaaggcatttgattagaaatatgaaaagaacctcagaaaggaaagtttaagactatatctggaagtatgaattctgagggcgtgtgaactgaataaaaggagccatatacattgtggtagcaatgagtgcagtcttcatgctgacaggagtatttctaagtttatgggagccaaacaccctgaaatcccacatctctacatatggcaaaaggttttcatccctaaaacacctcttgggtgttgccgagtgctgattccatgcacaaggagagacgtggctgtttctttgcctcacagattctgagatgcataatagcttctgctttttgttctggtgagaggtttgctttttaggatgtaaatgaccatcacgttggcttgaatctgttccctgcttttcctgcctatccatccttgtatatcctgcaacctccatggctaaggacaatagggtctgttggtaacctcagaggagattggattgtaggtagactctgtttctctcctgtcctctttgtgactgctctagttgcagtggagacatcggatcccatccagaagcatcttatttacattgatggcccattaacacaacatgtaacccaagaaggaacgcaacaataaatcatcagtcacataattaaataaattgaggcttcttgtgtaaaagtgggataacacacagtcggcggagcgttatttagttcaagccaagctaatattgttagagcaaacattaaggcaggtgacgaggctgcatcaaaatattaattatacaccattttggcactgataataaatgttcacgtatggccctctttccaggagaaatgctgaaatatgtttcaaagcaacgctttgaataattcaataaattattggagtctcagtgggagagctcgactgacatgaaagtcatggcgtccatttttaaccccccatccctggtttcttctcttctccaaagggctctgaatgccaagtctccatgtgtcttaaatgtatcattaaagacacattcccagacagtgagaaatgcagtgtcgataacttgggaagagttcagaaatcttgactcagatgtgtgagaacttttaaaatcacagatcttggcatgaggccaagtctgtgtcctacagcctggctaccttggctgagttgctcaaagtctctgagcatccctctcctccttcatacattggaagtactagtacctaccttgcaagattgttgcaaggaatggaaatgagatatgtgctacccttagaatattaagtttggggagttctggaagatagcagtcgtctccttaataagtgtggttgttactaactatttttacagatctgacttctccatagccttgcctggactccgagcagaaggttactgtgtgttcttttgtttacccactggactggagaatgatccaacattgctctaaaacaggatactgcacaggctcacctgggtagcagattcattcagcctagccagtaggtctttatacaaggaagactagacttggaagaacttgataatcctaaataatattatttatttctattccttctctatctccctgcactagaatgcaacatctgtaagaacaaggattacatttttcccatacatggcaatatttgctcagcaactatatagtggtagagttgacttgaaggatatatttaaaggaatcaatcaagagtgaattagttggggttttaggtgagtctgaaactcaaatgcctacagagatctacagattttgagttgggctgggtataaaatgataagggaacagcatagttcatggcaaaccaaagaaggcacacctcacccaagggtattcagagtcatttgatcattaccaacgacaggcacaaaaaactccatttgaatgcaaattcagcctccaagaatgaactttgtgaacttactgttttcaagttgaagtgggttaggggaacacagtgactaatgactatttaaaatggccaacgagtgccaccaaaaatagtcatggtgttgccagctctatcttgtctatttgttcggacttgaagtgatcttcgttgttttcccagtaggaaacaaacttgctaagaatcctgtattatcattggtgtttgccaatatgatatttattaaattagccaatggatgtgttttgaggacatgtcatgtgtcaaagatgatgctaggtgttagggctgcaataccaaatactagattattcacaggttcatgaggctcatctagcatcattctcacaactgctaacacagggcagtgcctgattcatagttagactttagtaaacatttgatgaatgactaaatgtgtaatcagaacaggaaagtgaaaatcttgcagatcgccagctcagagtatgtatgcatatatacataaaagcacacacacatataagcatacatatatgtgatacatatgaaatggcatattaagaccattctccatttatcgtcatctgattgtctagaattaagaacatttacctatatgtggaggaactccaaaattattatgctattgtttctaatctagaaagatctttaggaaatactggtagaacttcacatcttcagataagcttttcagtctagcttacccatgctttcctgtcctaaaattttctaagttttgatatcttgctaaagaaaaaatgaacagtgttaagcgttggtgcattttgcgtacttcaaccttttctgtctataaacaagcatctgtaaggcacctggaactctgctaacatggctcacatgttccactttgtgacttgatgtaactcttagctgcgtgcagcatccaggtgagatgtgaagctctcattcagtttacaaacagtaaaattactgtgtcttaataatgtatctctatgttgttgaaatttatggagaaaatgtttgtggtcaacaatgcttatcagaatggtgtgaacggtttttttatagcgatgtttatcaagttatgttgtgcatatgagtcatgtagagttgatgcttgggaaatcttgttaaaagaattgcttaggagatcttgttcaaatatagattcagatttggaagttctgggttagagcctgagattctgcttttctgctgaactgcaagtgatgggatgctaccaagtcatggaccacactttgggtagcaaggattttaaacaaataaggtccatgcatcatacatactattgtacatacatgattttgtgacaaaccacatacatgtcctatgctagatactgcgtcatttttgttatctccagtttacaggctgaaaacctgaaactcagtcaggtgagagctgttgtctgagttgcacttctgggaaactgcaaaattgagatttaaacccaagaactctgacttcgagcacatgttgttaatgtccctgtatgttgcttactgtctctgctggtacagctgaagcaaggtcttaggtctctaagcagatagcacctgaatacgcctgtatgcctctgtgcttggctgcattgtagagtgtgtttttagtaatacctgcttggggtactactgaattgaatagggttggaattctggatctaaggtctagtggaaccaacagcgaattctggacattagttctcaaggcaatgcttctcattgagatgctgtcacccccaggagggtatagaccaacttctttagctccagtggtgtgagaagagtaagcagggattgagtgtgtctccagaatctgaacagaatgagcttttatcatttttaccaactatgcccttgatttgtgttcaagatagagaataacttttggagggggttatttctggaataaaaagggaatttacttatctgtttagtgatggggatgatctttcctccaaatcacaccgtggaacagtctttgatcagtagaatttttctttgcagatgtcacagaggtattcgttccttgacatttttggaagtgtggatataggatggaaaggtttggaagggtggaggtaggatggaagggtggatataggtgttattctttgcaccatcaatctacctgtgactggtgatgcaaagtataatgcccttccctcccaaaagtgtaccctttgcagaatcagtaggaagtgaggaagtaactccttttaacttggatgttagcagtcatcatcctaatcattccctattttaatcacagaaataaaaggaagaaaatcattcttgagtcggctaatgctatgttacagaaccatagctattcattggtaatagctggaagactgttctcttatgcccttttaattgagtgtctttccgtcctctagctgtccaatatctgtttaatccacaaacaagactaattttgactcaaaacatagctggccctagtacaagaagatgcattgagcaataggaattataaaatgaaaaggtaaggatggttgcatcctggggggaaaatgccttcccaggcaatttgagcaaacaaaataatgcaaatgtcttctgaatgtagtaaggagttaaggccatcagtaaaagagagcaaattgaatgaataatacaaagaatcatccctcagtaagagaataatgatttcatgaagcagtgtagaaagaggagggagagtagagaaatctgaatgcctttgatagttgagaatgaaatggaaatgtaacagcttcacaaggtgaatatggagaaggggtaggagaagaggaaacaagatcattagagataacccgtggttttaagcaaaatgaggggaagacatttagaaatttgtaaaattgtgaccacagcattttttgacagtggaggaggaggggtatgtagcttggatcgttgtatttagaaactaccttttttatgaattttgctgcattacctgaaagtgagcattagttacttgtataataagcaccaaaatagattgttgtgagcatagcagtgatgtccgtgtgaataacatgtgcactaagaacgaaggtgaatatggagaaggggtaagaaaagaggaaacaagatcattagaggtaacctgtggttttaaggaaaatgaggggaagacatttagaaatttgtaaaattgtgaccatagcatttttggacagtggaggaggaggggtatgtagcttggatcgttgtatttagaaactaccttttttatgaattttgctgcattacctgaaagtgagcatcagtcacttgtataataagcagcaacgtagattgtcatgaggcatagcagtgatgtccgtgtgaataacatgtggagggttagataattgtatgtggaaaagaaagggacatggacaacatagcggtcatcctattgtgtctaaagtgaatttagcacacatgggcgaaaaaggaaattttacgtatcaggtgttcagtgaatattggaggtgtttgttgtggtggtggtagtttttactattctgtaaaatgcacagtttcaaataaaggatattgttatttccactttaaaatacataagaaactaagtaagttcttcttgataccagaaaggggtccaaatccagacccctagagagtgttcttggatctcaggcaagaaagaattcagggtgagtctataaagtgaaagcaagtttattaagagagtagaggaataaaagaatggctactccatagagagagcatccccaagggctgctggttgcctatttttgtggttatttcttgatgatatgccaaacaaggggtgtattattcaggcctcccctttttagaccatatagggtaacttgctgatgttgccatggcatctgtaaactgtcatggcactgctgggagtacagcagtggtcactctgattgccatcttggttttggtgggttttggccaccttctccactgcaacctgttttatcagcaaggtcttcttgacctgtattttgtgccaacctcttatctcagcctgtgaattagaattccttaaccatctgggaatgcagcccagtaggtctcagcctcattttactccgctgctattcaagatggagttgctctgattcaaacacctctgacattcttgctgagagccgtgagttctcttgctggggttagatgatatgagatggtggaggccgcagggacggaattgtttcttttctagatctcttccttagtttactttctttcttccctttgtaaaaggaaaataaatcttgggacctcaaactcactaagccaaagggaaaagtcaagctgggaactggttcatgcaaacctgcctcctgtttttcttcctcggtgtaatggctacaaagatggaaagctacatacctccctcacctcttgcccgcctgaggcaaatgcatatccaatggcatcctttgccgtattgtctacattatcttatgtaaacatgcagattagctgagacagacaaaggcataaataattattttctcttatcctccaacatgaaaattgtatacttctcttgatcttgccctttcccctttaaatattgaaaccttgaaaatcatcttcttagaaaggtattagacctgtctcccaggcacatgttcttaactttggcaagtaaatctaagatgattgagacttgccttggtcattttccttgattaacatgtctttataatctttcaaaagttatagactctgtgttggaatgaatgtgtgtgtgtgtgtgtgtgtgtacatacttgtgtgtgtgtagtttgggtctgtgttgtacaggagtaaaaaaaatggctttatgtccactgtcagtgaatactgctgtgcctttgcactttgactttaaacaagagaaggtgtaattgataaagaaactagaagccaggcatggtggcatgcagctgaagtcctagctacttgggaggatgagttgggaggaccacttgagcccaagaggtcaaggctgcagtaagccatgatcacaccactgcactctagcctgggtaagaaagtgagatgccatctctaaaaataaaatagaaaaagaagctgaatttttccaataaagtcccacatccaactgtctggtggaactaccaccaatggcttctcattggtggaaacagttccacagattttttttttttttttaagaaaaacctaattgcatgtgaatttttctcagacaaaagtagttctaagagtttaccaagaaattaaagttcttcaataattcagtgtcaaatacatacgtttgaatactgaaagcagcctcttaatatccatcttcttattggctttttgtcttgctttgccttgtagatttttagataacgtctaaaggaaaacaacaaaatggttgagggggaacctcatggagtcaatttgtttttcactgtggaaaatttctgtagtcagactgatttttgctccttctaggcgaattgttatatttgcacacattgtcaaaaagtcattgaactatctattgctggtgactgcacacatccctgttaccagctctgtagtcctctgggtttgggtgtaaaaagagttgcctgaaataaatagttaactgaaactcagcctgggagctacatttctgagcacttccgttttctacttcttacaaaatacagttcaaaaaattctagactgacattcaaagtactttttcatctggctccagcctgtttcaaccttaagtacacacagtgatataccgtaggctaggacattgttgtccccagggtacttacaatttccttcctgtcttcatatctttcccccacctggaggaatgtctaccccctttagctccaagtcttatctactcctcatagccacactcagatagtagtgattaatattcatatatattcactatgtgctttacatatgcagaatctttcattttcatagtaccctattaagtgggtaatattgtcattttatagatgggggaaatgagaaccagagaggttaagtaatgtgtaccaaatcacagagctaagaaatattggatcaggggtataaacctagacactctggcttcaaagtctgcctccttaagtattataccagacagcctctcaatacttacatctgccatgcaactgttcttcatcttctccagcaaaatttaagctcgctttttccctcaaatattcctatcgctctgcccgggctcatcattttctgttttgaatatttgttattcattatgatgagatgaatgcatagcctgtctgccaggtccttggataagctcttgggatgcaaagtcaaaccattttctcccttcagggaactgataatctaggtttggagaggggcaagcaataaacatctgtgaggtagatgattatgtgataccttatgccgtatcttagtgtcttttaatagaggtgtgaatacaagatcatagaaacatagggaagaggggctagttcagccctcgtcgcctggtatgggcaggaagactctactgagaaaaggtacttgatctgaactttgaagcatgaatgtaattttcctaaccagagggtccaggaataggattccagtccaaggaagtgggatgaataaaacctcaaatacactctcttcatatgccaatgttcctggatgggtttacaccatctcagaattccagggtgagcgggggggtggtggaaatagacgaattgcaggaatttttactgtaagagtaaaggaaaaacatttcagtgaataaaataaagatgtaatgtttgccttatcctctaaatatttaaaccagagatcaaaaagtcaaatttcaactaggtgtggtggtatgaacctggagtcccagctactcaggaggctgagacaggaggattgcttgagcctaggagttccaggctgcagtgagctatgctggtgccactgcactccagcctgagcgacagagtgagaccctgtctctaaagaaaacaaaaatagattttctgcatggggccaaacaggaaaagggaaatgtctaaaggcaatagagatgggtggggcctggggagagcacagactcttcctgaaggaagcatcagcttgtaagcttattagacttggagacacaaaaatatggtcccagtatggttagatgagttggatttgtagatatttaatgttgattgttaagccctggtaactttgcgtaaattgttttaagcagtgagtggttcacatattttatatagatgggccacttagataatctcacttgcagtttgtggtctgtgatttagaccaaacaggcttagctcagagtttctgtgaaacaggtaacactaagtatgaaggtgcctgcttgtagaccaagtctaatccgtcagcaattcctgagtgcctacttgatgctgagccctctgtgagatcctatagagtctactaaagtaactggatgatgaagagggctcttaggttaatgcaagtttagaaaattgtgttttggcaattggcacataaataccaggttgtccttttgatatcactctgttaaaatgtataattctggaaatgttcctcttgttttgagtctctgatggagaaaataatgagtagcaacagaatgcatgtaaataggaggaatgtgctgtggtgctgcacatttacaccgttccctatcatttaaggagaccagctgataaaaaaagatacatgtttatttcgtttgttccttccctaaccccaatttgctgtgttattcttccggattttcaggaggaatcggcataggatagtaatcagcattgttttcaccgtgaccatgctttttccactatactctctttctcccactctctctcctccaagtccatttctggcaaagagctcttaagcagtgagtttttttttttttttttttttttttttgagacggggtatctctctgtcggagtctctctccatcgccaggctggagtgcagtggtgcgatctcagcttactgcaaactctgcctcctaggttcaagtgattgtcgtgcctcagcctcccaagtagctgggattacaggcatgcaccaccacacccagcaaattgttttgtatttttagtagaggcgaggtttcatcatgttggccaggatggtctcgatcccttgaccttgtgatctgtccaccttggcctcccaaagtgctgggattacaggcataagccaccgtgcctggccccttaagtgtgtctttatagtagaggtttgtatgctcagccttccagcctgtggagctgtgtgctattaccaagttttactctctgagtacatagcctgtagttgggtttgaatattaagtgtcaaattccaatacaccaatgagagatttgaagcaaccagcaggtagcttctacatccctaaaagctgcagagcgctgtctgtgtttatgagcggtctcatttcacacatgtccaatgactggaatgaagctggtgatccagtgtgtgatgctgaaggtaccattacctgcagctgtcctctttcctgaaatgaggaggggacaggggcaatggctcaggaggaaaacgtgcagagcccgctgttcacaaatgtgaaggttactccagagagcgccgggagcgatttgtcagctttgtttgcaaagagatagggagtgaaggattgtgatccttggcaccgataatgtcccctgggccacaaactaatccagcaggacacctgatgtaacacagctattttattcacatatgtctgtatggttatcatagagggcaggaatggaataacaaggcttaggagataatcatcaaacaacgtctccctcttctgtaaaggaagctgagcccaggatcttcatcctttcagccgtacaagcagttgttcttctcacagacatttatcgagcattttgctacatgccttgggcacggttggaaggtccctcacttcgcagagagacctcatccatggatttagtcactcacacgctcatccattccccagacactgcttatgaccttggtgccaagttcagtgctagattttcaaagaagaaaggggataaacatttggctccggaagcagaatcctggctttattactaaaaagctgggtgatcttttctctagcagcctcactatacttatctggaaaatgggtataaaggcagtttcacctcataggtggctgttacgattaagcggggaggggatgtacttttttttttttttcgaggtggagtctcgctctgtcgcccaggccggagtgcaatggcgggatctcggctcactgcaagctccgcctcccgggttcaggccattctcctgcctcagcctcccgtgtagctgggactacaggcgtccaccaccacacctggctaatcttttatatttttagtagagacgcggtttcaccgtgttagctgggatggtctcgatctcctgaccttgtgatccacctgcctcggcctcccaaagtgctgggattacagacgtgagccaccgtacccagcctgtgtattttaagaatacttagcatatggcatggcactgttagtgatcagatccacatgagtttacttgccagaggaagtccatgcatgtgttaccacaccgaggtaccggtacagaccccaagagagggttcttggatcttgtgcaagaaagaattcaggatgagtctgcagagtaaagtgaaagcctgtttattaggaaattaaaggaataaagaatggttactcgatggagaaagtagccccaagggctactggttgcccatttttatggttacttcttgatgatatgttaaacaaggggtgggttattcatgcctcccctttttagaccacagagggtaacttcctaatgttgccatggcatttataaactgtcatggtgctggtgggagtgtagcggtgaggaccaccagaagtcagtgttgtcgccatcttcgttttggtaggttttggccggctttcttactacaacctattttatcagcaagatctttatgacctgtatcttgtgccaacctcctatctcatcctctgacttagaatgccttaactgtctgggaatgcagcccagtaggtctcagcctcattttacccagcccatattcaagatggagttgctctggttcacacgcctctgacacatggatcacaatttggagagcacggataggctctcatggatctgctgtttcactgtggcttaaatcccagcctctacttactggtggccttagcattactgtgaccttgggcattttataaaatgcctgtgaatgcctctgaaccgagtttcctgatctgtaaaatgagaatagtggtgatttgtacagtagtcagggaaatactgggtagaagagggcagttccttggcaaaggcttcaccctcaagcctggatacttgtggccttaaatagcaacagacattcctgttgctttttggcccaccacacccccctatcctatacccatataaaccccaaacacccagttccagaaggagatgaagagacaaacagaagggcagaagaatggcagaatggcatggcagaaagaagagagggagcatctgaacgctgagaggagttcagctggggacagtcagagaggagattggccactgggtggcgaaacgccagaggaagatcatcttcccactccatcccctttccagctccccatctatccagatgagagccacctccaccgctcaataaaacacctgcattcactatccttcaattctgtgtgtgacccagttctttcggggtgctggagaagagctcaggatgcagaaagctgttgcactggtcctctgcatttgcaaataggcagagggtctgctgtgcttgttaacacttaagccatccgtggatggcaaggctaaaagagcacactgtaacacacgcccagttgggctcctgcagctgtctgtcatcatgctccacctcctgtaaggggtttgagcagtggcagcaattgaagagatgagccacacccctgtctcatgtcctgcgagggggtcagggaactctcttgtttcaatggtagtgtctgtgaatgcagttctactgcacagggtgctccatagacaccctggcttgtttttgctttccatcacactgatgtgttagtcatacctcacacagtcactcacagctccccaagtatatcccattgttatgcacttcatgtacacaatgcatccctaagacataaaaaacaatcatcaatttatttgacaaagtgtgctttgtttataagttttcacaataatcagagagtgactgctggtaagccttgatttcttttcaaattcagttgaacgcagctgtaaagtgcctgaactttgcctttagctaagcagatcctaatgggttcagttagcattgtatatgcatgtgattgaccaaaaccttccttctgggttggcaacagcgctcattaaaaagtgaaaatacccttagtgttaatttaccaagcagtgttcgagaatgacaagccatctcaagagactgttttccaaaggttagcttttgaaattaaacaaattatggtgagtttacatatttgttggatgcaagtgcaatctgatatttaaatggatcatgccaccctttggatgttcatggaaaatttggaattatagcctattttggttttttgatgatctgacattcctcatgtggtgcttgagaggttaagaacccagaggggagccttggtaggcactggtattcattggtgacagtggatggaaaagaatatcaggatcttgacccctttcctcgtgctatttctgcccttgtctctgatacttcatctctgttcccaggtaaaaggcatctgccaattgcaacccacagtcttgtttgcaaggaaagtaaccccaagcaatgcagcagctggtggtaacattagaatgaaaggggcaggctgaatactagcaccatgggaaagaaaatgcaagtgtccgatgcaggggccttagccccacaaactcatctgaaacagtggacccttttcctatttttgctcttccgtctcttcctcagaggatgataaataatgtgataaccatgttatttactgacatcattgttaaatggctaaagttgagcaggcagatctaattcttttaaattcatcaattcatgtaattctaaaaatagcgttttgagatgagtggcagtatcatgacttccatattacgggtgtaaagattgaagctcagagaggtcgagtaacttgcccaaggtcacagcgccagcacatggtgaagcgcacgtaagccaccagccagagtgatttcagagacctcattttactctaccttcccaagaccccagcgtcatcgtcactctcacatccaggtcactctctaccatttggccagtttttctcctaaaatatggtcagaacaagtcattccccttctcagagatccctaatggatccttaatgactacctgccaaagcctaaactcagttatttgcagtggccaaaagcgtggactctggcgtctgctgggtctcagttaaaggcgtggctgtccttatcactaagggatctttgggaaacaagtctgtcggggttcagtttcctcaatggtaaaaaaatggcattaaaaacaccaacctcagatggcttcactagaagcccacaccctcgttttaacacaatatacctctgtaacaaacctgcttgtgtgcccccagaacctacagttaaaataaatctaacaaaagcacctacctaactcacatgtacaatgggataccattcagcttcaaaagacaaggacattctgtcatttgtgacaacatggttgaacctggaggtcattatgttaagtaaaataagccaggcacaggggaacaaatactgcattatctcacttatatgaggaatctaaaaaagtcaaactcatagaaacagagagtagaatggtgtttaccagaggctggtgagaggggaggaaatggggagatgatcaaaggatacaacatttcaattagacagaagaaataaattcaagagacctatggtacaactatagttagtaacaatgtatatacttgaatatcactaaaagagtacgttttaagtgttctcaccacaaaaaagataagtatacacatgttaattagcttgatttagccattccacagtgtatacatatttcaaaacatcatgttgtacaccataaatatacacaatttttgtcaacttaaagaataaaaagaaatccctccgccaacccaactacctacctcacaaagttattagcgagacttgcacctgtggtacatataaagtatttagcggagtactcattaaattcgtactgttgttaggttggactcatgaagcctccttcatctagtttcatctttccaatttccctcaatatctttcccacattctggctccggaaaactattcctgattccctcatatggcatggggcttcgtgcatctagcttgtagccctactctttcattaagtgacagtgttttcaatccatgcattatcacagttgccacttttaccaagtccatttactccaccaccacctcccaagtcaggatacattgctcttcagtttttctgctgggaatcttgttttgctgtgccttctattagctattattaatgtgagcttgtttagaaaatggaatgccccatttatctctgaatccctaactgtacctggcatcatgctttgatggttttcacaaagtgggaactcagaaagtgccaaatggattaatgagtggatgtgcacattaaaatgaacacaagtaacttacattatgttcctttgaaaaacatttatttcctatgagttgtcattgaaaaaaaaatccttgaggatcagaaacagaacctggaaactttggaatgtagatttttttctttgcttctttaaattgtagacttatttaaatctctacatatttcaaatctaaaagaaattatgcacaaccagactctaaatccatgtggaataattcagtatttcatatacatgagttctgtatttttgatgggtgtcacatgccaaagaatgtagactatggctagaaattaagtgggcttttgtttgtttgtttgtttgtttttccaattgcctagataggattttgccttattaggattaaagactgctttcttattaagcgatgcaggtctcattgaaataagtacctttatgaaaatgatgcttttctgatttttgtgaaagattgaagcattttagggtaacttggaacattatgagatctagtttccggagatgtgagtaaaattaactccatgttgtgaagattttcaaatgaaaaaaatattacagaaaacgtttagggaaggctacccgtgtctgaggaggtgtgtgggaaatctctataattttctctttattttgctgtgaacccaaaactactcttaaaaaaaggaaaattttataaaaacagtttaggggagtgcctagaacttagcaaatgctctgtaacttaatgctcaataaatgctagaatatgcttctactagatctggacccaaaacatgaggctttacctattaaaagttaagaatatttatcagaattatatgcaagcatttcgtgaagcatcagatatgcagtatttcatttaatccttacggggatccggtagcacaggtagtccagccacttggcagaagaacatcctgaggttccaaggggtctgtaaatgccccaatatcaaactcagggaaaaatcagaaaccgagctttgtttactgcaggttttcagttcttaccactatatgttactgtccgtcatgacaagaccggagatgcaaatatttttatctcaaaacttcctacatgtcctgtggcttcatccacaatgtttatttcttacctgaaatcatgctatgaagaaagtattgcccaaaacacatttggatgaggtggcatattagatacataacttttgatggttacctgaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtgtgtgagagctaatcacagccccatggcacgtctgagctcctttcttgtaaaagcacatcaatcagtgtctttctcgggttatcccaaatccttccacgggtagtcataagcatgtgatgtctacttgggatggaagcattctcattgagagcaaatatagcacaactgccattcagaccacagttcaagttgtggcttctcagtgagaacacgtaccaatactaaccctctctgaacatcatgcttaatctgtgaattggagataatgatgcccagggcatagggatgtcagtgcaatgctgcatgcaaattgtttatcagagtgcatgacacagagttaacatgagatgctcctcctcctccttctttttcctgttaatttttattattttcttgctattggcattgtctttatttacacatactcacatgcatatgtctttatcagtcccagatagatatttactgagttcatttaaatcgcaataatttccatcacttttacctgtgtctcaaggccctcttcagcttgggaggacttcaatatgactcaagtaggtacagctttttaaacacatactgtagtcatactcttagctttttttttttcctgtattacctcatttgatcatggggagaatactgtaaaagagtactttttatttccacctcgtgcattggataattgtggccagagatggacagtaactcacccaaggtcaagcaactagcaaatgctggagctgccagttgcaccaagtgggtatgacttccaagttcaaagctctttcttcacgtatgcacttgcctctgaatatcatggtctgtcctctaactgaccccttaggagctggacatgaggtaggtaggaagttgagcttcaagaaggagctgtcagtgcagggtggtccatgaaagcccctgggtctcagatggcagagaaacatgtggtttctttctagaattattcactccttcactgagcccatatttaaagcgcgttggttttgctctaggcactctgttgagtgcagagtatttggtggggtgcaaaaccctccatgtctgagtcctcaggcagcattcagcctggtgggagagacaggtactaatcaaatgcttatgttttcctgtatagttatagctgagataaatgcaatgacaagggaacctgtcctagatttgctgcagaaaccaatcaaaggaggctttgctagggaggcagtatttgagctgagagttgaatcatggatggaaaccacacaggggatctcctttcccttcaagccctgctgctggagccgggcaagttgcaggggaccctgagggctctcagttatcgctcatgcatcgaaaggaatggaactttctgcattagatttctgcagagattagcacttcttttacgtcagaggcatttttatgtaagaagtctactgatttcttcatggatgaaatcctttggccttcttaatagcacgtgtgtgccaggccagctccagaagctgatagattcaggtgaactcagttcatgtgaactcaggagcatttgctgagaagcctgattcctcttggtcagaagaactcactggccgtttctacttagatgggaaggagcattttcatctcccaaacaattttgtgcaatgcctgtaatcagccagcagttgccgtccatttctgcctgtcttttatcattgaacctaaaagaatctgtctgcaggaattaaaagttgtcgttttctctgatatactatgccttgcactcagtacctctaaggaaatgtcacagaccccccaaaactcccccatttaagtggtggaaacatggaattctctagtttcatgatgggattggtaaaggaagatatagctactttgtgaacttggtgcttataccttctctccttttgctagacatgaacctgaaggcaccacccaaaaagtcaaactagacaacatctctatttttaaaaaaggagaggcagactaaacattacatcagcgtaaggacttcagagtcacacagaactggatttgcattctggctttgctgttgactagtggtaaaacctgcagcaagttctttcagattcgtaaacgcccccctaggtcatcctcaaaagagaaataatggtggttgtgcttagagagacttctgcaagtaaagtgcctagtacatggtaaatacttggtgttggatagtaatcattattgccgggcaggaggctgaggcaggagaatggtgtgaacccgggaggcggagcttgcagtgagccaagatcgcgcactgcactctagcctgggtgacagagagagactcatcttaaaaataaaaaaaacatcatcattatagctattaatattgtccaatactaaatggataagaaataaattatttcttatttatactaaattatttctttctaagtctaattgatctaaatacatatgtaaataatagtcattatataatatcatttaatatattaagtcattatataatatcatttaataatatataatagagaaaatgatataacaatctgatacataatgagttttaattatatatttttataaatgatatttatgatttatatctttagattattaatatttatgtatttttataaatgataatcatttatgttatttatatatttctctattttgataattatttccatattttatacatgatgattgtttatattatttatatgtttatttagattgttatttacatatttgtatcagtgataattatgttatttatatgtttatttggattattacttttatatttctataaatgataatttatattatttatatatttatttggattatttacatatttttataaattataatcatatattcatttaggttgttatttacatattataaactgtaatcatttatatattcgcttaggttgttatttacatatttttataaatgatatttatgttatttatataagtttctttggattgttatttacatattttataatcatttattcatttatttatttaggttattatttacatacttttataaatgataatttctattatttactgagttatttggaatgtcatttacatacttttataaattataataatttacattgtgtatttatctatttggatggttattatttgcacatcctataaatgatcatcatctgttatttccatatttatttatttggattgtgattattatttgcttattccttatgtagatccttgtggccctgtgtgtgaatccatgttcttgagcttgcaagccatgtgttggatcatctgttttgcttcgcctttgtggcatgaaagcaatcttagataacacttacataaatgaatgcacatgactgcatctgagagaaacttttttacataaaaatactggctgtgtgttgacttgactggtggaccctagtttgctgagtgacagggttgcctgcacttgaacatcctgctcgtgtggctctgagtagttcttacctggatgacttagtcaccaaaatgtatgttgtaagtaaaagaagccccttggagctaggctgagccagagaggcagttttttggggaaatgcattggtgtcacgtttggtatgcattggatgcagaaattgcatccctgatttatgcgaaaagcaggctattcgaccaggtatcaggagttgtggaataagagatgcaaatgctgtctggaacagcaggtgccattcttagaaaaatagatatgggggatgtagaggaacaccaaaagtatttcccaactatcactcctaaaacaactttgctcagtagctgtctccccctgccactttttaaactctacagcacattttaagtgccttgtccgagcctggccagagggacgtctctctgcttctacaagaataccttgatgatatttcccagctgaaaagacttacctctctcctctcaccctatacccaggaagttttaattttatggagattgaaataatcaggtctcatgtgtatatttcctttcaaaccactgcgttcgcctgttttgaattcaatggcctgtcttatgtactcggtggagaaataatataaacaaaccttgaaatttccctggagttcagcttcccttttcatactgggtctagctaaagtttggagccaactaaaaagagcctcattgccttacacacaccctgttatctctggcgggttcaaatgcaatttctctgagaaggctgtggtacctctgctctctctggccttgaatctgagcgtctaaggatttctttggagtacacacagttgcatccttctgacagacagtgcaaattaaaagatccggcgcggcccaggaaccagggacccaaacttgccccttgggttttcatttacagttaggcactgcagacacaattattgctgacagggaagcggagctggtggcagagtgcgcctgacaggaggctcatgccagcccataattgggaggattatttttaatcagaacataccctacagcccaaacattagaaatctcctgtaaggccaagacaggaaattaaacacaccaacaataaggctcaaagggaggcggtgtgtggggtgtaatattgttagtctctcggaggtccctagagcttcggggagaagtttgcttccctacagagggaggctgggaggaacagaagcagacacagagactatacctgagcccttgttgaatgggcaaatgcagccaaattaaatgcagcagaaacactaattgcatttaagtgcaatgtgtaatgcgtttgtttcttgcaaatgcaatgacgcttattgactttagtagtagtagtagcattttgagacagagtctcgctgtgtcgcccaggctggagtgcagtggcacgatctcagctcactgcaacctctgttcaagtgattctcctgcctcagcctcccgaggagctgggaatataggtgcctgccaccacgcccagctaatttttgtatttttagtagggatggggtttcaccatattggtcaggctggtctcgaacttctgacctcgtgatccgcccacctcggcctacgaaagtgctgggattacaggcgtgagccaccacacccagccgcttattgcctttaagcagcataagccacatgtaaaccttggaatagcggatacaattgtatttcatcagtaagagaagagcctcactggttccttatttttaggaatcttcagtgagcacttactacgtggcaggtgctgtgatggcttatgatactaggctatgctgaaagtcatctggatgatcttattgccttggcaaaattttgcacagcacagtaaaactttgtttattaaaaggattgttgttgaagaagtaggcgtagcgcttggctgtttggctccagtaatatttatttagtagtagtgccaggtaatttagctgtagtgtcctcacatcaaccctctgaggtgggcattattatacccattctatggacaaaaaaactgaagctccaagcggtcaagcagcttgcccagaactaataagataactgactttgaaaccaaatctgtgtccaaaacctgtaggatgtcaaactatttgtcaaactgtactgtcactcatgaatatgactgggcacagcctggtgcttcgaggtgctgccactccaatagaaaagacagatgtagagacagatgtctacaaatgaagagtctatagagatgctaactggattctaagagtggggaacatggcatgattcactgtgcttggggagtcagccaggactccctgaagctatgaagaacaggtgcaaatttaccagtggtttaaaaaaaaaaaaaaaaaaagaacagaatcccagacataggaaacaagtagtgcacaggcacagtgttatcagagatgctaggacatttcaatttagtttagaactattggcttgcctggatgtggtggctcacacttttaatcccagcactttgggaggccaaggcgggcaaatcacaaggtcaggagttcaagaccagcctggccgacatggtgaaaccctgtctctactaaaaatacaaaaaattagctggacgttgtggtgggcacctgtaatcccagctactcaggtggctgaggcagaagaatctcttgaacacaggaggcagaggttgcagtgagctgagatcgtgccaccgtactccagcctgggtgacagtacgagactctgtctcaaaaaaaaaaaaaaaaaaaaagaataaaagaactattggcttttgggttttgttcttgttaggctcactcaacaaatataaagggagaaaatgaatctctctttggggaacgctcatcacagagaccaagcatctgatgtggggatgggatgggaagcaaaaggagatgatgttggagaatccgctcctgaagtcaaaggatattccatgctgtcctcactgtgtgaaatgcctacgcctgatggcagggaaaggtggtgctttaacccatgactgtccttagaaaagcaaccacaggtttacagtaacattacgtattgcttctgaggctggagttcagggtgcagagatcttcagtgagtccaggaaggcatgaatctttcgcatggcagactgaggcccatcagatactctgactgcagtagtggttactgctaagcagcttcctgttatgtggctgggagtcactggattcccatggggagggcttctatctccaatctaaggtggcttcagtgcacttcctgtctagttcacttctcccatcccaggtgtgatgggcactaacctctctaccaccaggaatcgcacatcataatccctgagtggtatcaagcaaccctgggcagcttgctgatttggcttcagggtcctttcaaggacagttaaacgccagacacctgaatgaggtcaggggctgctgtgaggcttggagagcatgtatgcaatcataatccctgatgtgatcaagatacagtttgcttccctgcctgcagggtgggtacaaaatcccaacttaggtgaggcaccaccctctgagatggtcttatacataattgcattgtttgctagcaacagaaatccattcaaactcactcaataaatgggcatgtttcttacacagcacaggagcacagaagtgagtttcagcactaaaagtcaggaggtgttctaggtcccaggaagaaccagcatttctgaaccgctgtgtaatcaggaaacaaggcagcccttaccctcccgccccaaaaccctcctccatggctcttccactctcttcttcttctctctctcattgctacttctgctgttttctgcacacgtggcagagaagagtgaccccacagttactgacgacacttaagtgtgccttgcaaattcctaggagaaaattgaacctagatagggtgaggtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgccatatccatagcattgtgatcagagttaaaatagtgagcaaaacccacacagctcctgccctcatggagctaactaacatgctggtgagacaggcaaactttcatcaaataatttttctaataatttttaattggatgcaaaatgcaaactgggatatgggctatgaagaaagggtgatgggctcttaaagccatgtggtcagggggttccaacaggaagcagcaatgcactggagttaattaggtgctaaaagcatccccagtcaaagccatagcatgccaggcatccctgtggcaggtgaggagtaaagtgtggtccagaatgggaaagtccatggtgctggtacccgggactggggggaagtgtgatctccttactaacaaataaataaggctggagctgtgtctaggagcaaatcattagggatgtcaggagtaaggtaggtttggaatgaaatgggaagccagcaatgtaggatttaaacaatcaagtaacacagtcacatttacattttgtaagggtcacactccttgacctgcatgggggcaaggggtgcaagcctggaggcaggaggagatggcattgcattcattgcctggggaagtctatgaagcagttcatggcagaatctatggaaacagaaacgttgcagtagccagccctgtttagagagtcagagttagaaaaaaactacattctggctgtccaagggtcatcaacaccagtgttttggaagtaatcggtttgctattttgtgcatccatttggatggagtgcataggtgaaggtagctaatgcatgaactgagcattcaccttcattctgcctgactttgttccaatgtcctccgagtttccttcacttgcagctctttagcttctgtgtaatcttggtacaatgaaaattgtgcccaattccactgggacctgagattctccctggtcacaaattgctcttcacgtagtttgcaagagtaattgcaaactcagaacattttagttaaaaaaaaaataacactaaatcactcttctggaactctagagagcatattagggttttcttgctgtctggtaccattgttaatgatcatttctgttctcgctttataacaatggttctcagcctctgtttttataaaataatccccctaaatgactttacaggttcttattagtggaaaggaggggctataaaattcatttcaactgtaggttggattaagaccagatgtaaaggtgtgggtttggactcagatggacatgaaattcaatgttattacctgggtaccaagtacggtagcaccaaagaaggcccagttgctcagagaaacctctttctggaatgaaggtcaatgtcctttcttggtgctgtaaccctctggggcaaggaagaatcacttgttaggctacccaatgtagtgagcagtacataaggggccgtttcccagactacatagttacagtgttgaattaaacattgcccttgccttccagaaattcacagcctgggtaggccaagtccacaaaaagttagaaaggatgtatattctgcttctgatagaagaatatgccaatggccatagggacctcccctaaaattcaggcccactggaagggtcaatgaaagttacagagagcacgcttgggtagatgttcaagtctcaagactccagaccttccatgagttcaaatggggccaggtgaagggcagtttaggatgagagaaggttgtaatcgaagggctaaaggaatactagtgcactgtgtcttaagtatttgatttagctggatcttagaatgtaaggatatgttcggagatggaggaagtgacaggaaagagggggtaggagctgaaaaggttgaacctgaccatggtagctattatttttaataaatgagaggatgcatgcaaattttgatatgaagtttgggctgtactagggattcagtgaaactacaactactataattattaggactcagataatcctgcattggaggcatactgtgaatctctagaagagaaccatgtattttgactatttctattctaattattctaactattcttcccaaatcatgttcttccacttctcacctttacgatgtcagctccgttgccacttccttgatggagccttccccactgtccccggtgaagatctgtctatcttccccactggactgtaggcaccaaggggacagttcctgacatttagaaggcttaataaacaataaacttttaaaaagcaccgactttgtgctaagcacaatgctacttgttttacaaatattaacttttaatattcacctgaattccttgaggcaggtactgtttattcccattttaatgatgaagaaactcagacaaagaaaggttgagtgacttggccatggtcacaaagttagaaggtagtgaagccaaggatgactggaaagatggatggatgggtaggtgggtggatggatgggtagttaaatgggggacagatggatagatagatgggtggatgggtggacggatggatgaatgggtgggtggatggatggatggatggatgggtggatggatcgatgggtctatgggtggataggtgagggatgggtgggtagatggatggatgggtgaatcggtggatgggtggatgggtgggtggatgggtaggtagataggtggatggatggatgggtggatgggtgggtgagtacatggatggatggatggatggatggatggatggatggatggatggatagatggatggatggatagatggatggatgaatgagtgcatcattgctgtttgttgacactagcccatgagattggtcatttttattagttgaaagaaattgaaaacatcaaaatgcaaagcaaaaggctattgaagggtgaatactatcaccaccatttcaaccactgaatagctctatctattcttgggtctctctgcaggtcacccctctttccaatattttgaagtcacttgatgtttttaggtgttgtaatttatcaacaagaggggactcaccagatgtgaagactacacacacatatatatatccacatacatacacatatgtcatcttcatttatatgtatatctgtatatctatatatctagatatacctatcacattaggaaagggggtatattgtctaaacatatctgcaaataatgtttaaaatttacctctaaatcttgtgaactttgttgagtcttggcgtaaattgtactgctgctttataagagtaattcaattatcgatggatcaggattccagaaccctgcaaagtagtcccgtctctgctacttaagtttctccccagagaggaaacaagtcagtatcccaacccccttgggtataggatgccgtaaacatctttcagatctaccagaactcttgatttttctggtaggagatgacctctctttcaactcactgaactataggagattataatagccatttgcagtttaggtgatatttggtttatttaaatatcaatgaacatgaatctcactccctgtgattgggtgatgatagccatatttatgaaatttattactgctaggataccttgtatcataattctactcattgcaaaattaaatcatttccatatttgaactttaagtaagtatcacctgaatgcacattgtagaatcctgcagttctagcgttgaaaggaaatttagaatttatttcatccaagctaattcctagggggaaaatccataatgatatatctgaaatgtcaacctccagtcttaccttgaacacctcctgtgacaagaactcatggtgtaagagaagaatacagaagagtacttccaagcttggtgttgacttgcccgagttcaaattcaggcttcacgatgtacatgcatgtcttgtcaactgtgggagctgtctgggcctcagtttcctcttctgaaatagagaagataataacaccttctttgccaggatctgagaggatgtaataaaaatacatcgaagaactgaatcattttcatcatcatcatcaccatcattgctgttaaattcacaatatagtcagaacctattttgaaggttggtccatattactatgacaaaaaaagtgcggacaaaattcaagaatacatttcttgatactaaagtcattcccctttttcttctttaggaaactggtcaaagaactcatgcaagtggaacttacagcttccttgatcggactcagcattcagtaagtgcaacccattttgaacattcattccataaatacatccatgtctttgatcctgttctctctgaaaagctcttttctgcaggtttgaagttgttacaaaaactttgctgcctgcctatgtctttctcttctgccctattgtatcagagatgagaagagggcctgcaaggtagaaccaccctcctttagccctccctccccaatgaacctgggaaatttgtgaggttatcaatgagttaactgcgcctttattagctggggattaaaataaaatgtgtttttggtttctttttttctccccctaaggttttcttatcaggagacattctgtcccccttctgagtcacatgaccctgcaaagtagaaagaaatgccagcaaacacagatcagttaccgagagcatgtatttcttgaggcatttaagaacagttcatttgctctttttgagctggaatacatgactatgatctgaaaattactgcaaaaaaaaaagaaattttttactttaagatgctggggtacattatagaaatttcatttgttttcagcaagtaagcatttttccactttctgcctttctcattgcatgcaaggactttatttttggtgaaggtagcagtattttgtccaattttctcagctctctttttttatatgcagatatactctagcatttggggtagcaccttcacaaagtctctgatgtcagccctcctctgcaatagttttatgggtgaacagcttgttttaagaagaaatctgtaataatttaattataaatatcaaaattttaaaaggctagctgaaagaaatatttatttttcaagatgtagcttccttcataggaatgcagaatttcttagcaggttctacttctgaaagtgctggagtataatttgatacatcaaatatcagcccatgtcataaaggagcaggtagaattggaggacatgggactccaggcctgcaagaggctgatcaaagggaattcttttgccctcagtgggattgcaggactctttctattgtcttggaatttgcatattcaaatgcagaggggaaggaggcagagatagaaagaactaaaaagatggtgtattagctgttagctacatcagaatgacttagcgtaaccctgatcagctaacgcttgtatctcacaggagattagactggcagcttttgttcctaataataaaggaaattccatgtctaattccctacgtgccacatctatcttttcatgcctttgaagttcaggcttcggcatttcttgaaaactgggaggttttgtaagtaaaaaggtgggggctgtttggcatgaagtctgttcaaatctatttagtgtaaagttaaatttgcttgttacttgatctttttctgtttaaagcagcatctttctcatagatgcctttgttggtgcttgggcagggaggggagggatggaggacataaggtttcaaggatgggttttcagatcatacatgaccttctcattcctctgtcttctgaatatgattgaaattgctgcttctctgaaagaaattcctgttccaaccctgcactgggattgaaacttttaacctaagggaggctgtggtccctaagataattagtacatggatgtaagggagctcatgttaatttgtctatggatatggtatttctgtatctacaactgccatctaaagagagacattaaaaaaagtattaatttactgctctaaaccagtgagcagatataattttttttaaagaaatcattttagaaaggaagcaatggcaagatgccttattggggatgtttatgggtattgatccctcttagtgtatctagtaggtttccatcctgtccttgggattgcagcttctctgatacagcaaacctcaatccccttcagagaccaagcagtcacttcctctggaacaaacattgaattctgggacgtcgcctggttatcaggaaggcagatgatttgacatctaagctggccacatgcctgggttttgtgtgttcttcacccataacatgttggatgcatgctggttgagaaattgctccagtctcttacaggattttagcaggagcgatgacctagtagttggaatttgtacatggctgacactgggcctgggctgatgttgtgaagaatgccatattttagtctgaatccaggttttgatatgtccattggcttcagaaaattaattttcatttcctgcttccaaaatttggttattcttgtttaattttttccagaatgtttcctttgcatcggtaccctttggattgctgtttgttcaatagtatattacccctcatgatatccacagcatttactgtcgtgttggtagaccatgagtacttgttggatataatgatggtcgaacaggtacaacaatggaaagctgaataggtagatgaatgcttcttaactcctgatggagtattgtgtaaattggagaaagatggcattgacattagacaagagaccagtatgggtgtttctgatggttggtttctattccccaatactcttcttcaaagctttcacttctactttgacaggtctagagtaacagattggccaatgcacatggtgtaagagaatgagctcccaggaaccagcatctgttttctagctctccacatccctttgttgttatctgtgtgctaagaggaaagccacagaaagctcacagtagcagggtcggtgttggaacttaagcctcagcatgattttctacaacttgaaaatttaacttccaagaggtttccttgatctctattttcctatcaggctaaaaatcccatggcatgctgcatcatgtttataattaattaattgtgcaaactttatttttatgtttgtctttttctttggtctagtgctatccaatacaccatgtctgtgattataggaatatttttttttcaccaagtcttaatgaggtattattgaccaataagaattgcgtcaatttcaaaagcatactcttaatataattggctttggtgactgagagggggaaggttgggaggaggttgagggtacagataagaagaaggtggagacagaaagaactaaaaagatggtgtattagctgttagttatatcggaatgacttagcgtaaccctaatcagctgatgcttgtatcacacaggagattagactcgcagcttttgtccctaataataaaggaaattccatctctaattccctacatgccacatctatcttttcctgtccttgaagctcaggcttcagcatttcctgaaaagtgggaggttttgtaagtattgggtagagagggcactgcttgggtgatgggttgtttgggtgatgagtgtgccaaaacctcaaaaatcgccactaaagaactcatccatgtaaccaaaaaccacctgtacccctaaaagtattgaaataaaaataaaatttaatttttttttaaattgcgaagatttaaggtatatatgagacatgttaatgtacatataccttgtgaaatgattaccacaatcaagctacttaacatacttatcaccttacatagttaaccctgctaagagaatagataaggaatattctttatctgtgctgttcaatatggttaccagcagccagacggagcaagtgaacgcttgaaatgtgactattacacctgaaaactaactgaaaactaagtgttctttcaaaaactgttattaaaaaaaaatttgttactttattattattattatttatgagacagaatctcactctgttgcccaggctggagtgcagtggcacgatctcagctcactacagccttcacctcctgggttcaagcgattatcctgcctcagcctcccaagtagctgagattacaggcacccaccaccatgcccagctaatttttgtatttttagtagaaatggggttttgccatgttggccaggctagtctcgaactcctgacctcaggtgatcctcctacgtcggcctcccaaagcgttgggattacaggcatgagccatcacgttaaagtaacataaatgtgttactttagttttaattgacaaacaataattgcacatattcatggggtacatagtgatgtttctatacatatactgtatagtaatcaggtcagggtagttaacatatctatcatctcatttctttgtgtccggagagttcattaatttaaatttaagaacatgtggcttgtaacctgatactgtattgttgtatgggatggctttagactagcagccttataaatacaggggctaggtcagaagtgtccgtccttgtacctaggctgatacttagctgttatagatcaattaggactctgactgataaattgctactgtctcaagccccaaagtgtcctctattccctgctgttccatatgttctgcttccttgaatttacccttgatccagaactaaaggtttaatggtcccctgggactctgcacaatgccacagcattcatctattctaactggttggtgcctaatgcatgctgattattcaaatagtatatcacctctgattatttccatggcatctactgtagtgctggcccatagttcaccatcagtacttgttggatataataatggtcgggcagatagagggatggaagaatgaagagatagataaatgcatccaccttttgatggggtattgtgtaagtgagagaaatataacatcaacattagatgaaatactggtatgggtctttctgatggctggtttttatttcctcagtattcgtcttcaaagctttcacttctacgttggtaggtttagaataatagactccagatctatcactgaattctaatgccatatgcagcacagattgctatacatcttcactcatttctttctgtcacttaaggctcccaatgcataacacttgaaatcagtccacgtctcactcattgacccatgggcaccactctcttctcaggaacctcagtcccaagccttagttactaacattgtctttgtttttcatccgccaccaaatgataagtgagtgttttatctgtatcttctaagagacttcttttcattccctctgttggcatattgctccagggacttcttacttacgtatctgggaattctttctaggtagtcttcatacctaaagccaccttcccttggatcccagccaacagattgcaggactaatattcttgaaacaagaatatcgtctagttggttgttgaataagctcatccttacctaacattttatcttttctccatgaatccctcaatacatttcattccaactgggcaagttcatctcttgatatctaaacatgtttatttcccagctccaagcacttgctacacttggtctcaccagttgggatagcctttcctattcttttagtctacacttctatgtagatctctgttaagccctcctgataatgaatttttctctgtttatttcagctacttgattgccccttgtaggataaagaaaatcctaagccaattttcaacgtaggaagttgaccctatgattatattttagaacctgggtttcagtggaacaggcaggagtggaacagagtaaggaggtattgaaagagaaacaacaataattgccttccagggagacacagttctctcacatgcaaaattcagcagatgggttggaagtggaagaggttaaaaggcgccagttggaatacaagagggagagagaatgagaacaggcatggcctagggcattaccttaattcaaggccaggcacagggtgggtttcatgccagctgcatttagagtctgtggtctggaaggacaaactcatctagataatgctcattgaccatcccatttgctttgacacttccctggccaccaaccacccccacacactgttgtttacatttcccctatgaatatctcttacctctcctaagctgctgcatagcagagctcttttcccagcttccctctgcatataaggggcaggaactctgcagacctttttcgatcgaatgagtacatgagcatgggaggaaagagagagagaaagagaaggcagagagagaaaagacagagagctaaaagaagaaataacaattccttctgcttctttattgttaggacagagcaggataataaagaatggaagttacaaggaaggtgtgtaaagtagtagcatgggtaaggaagagggaagcccaggcagcaccccactgtcagcctcgttcttcttcatcatcttacccagttaaaatctgccatggtgcttatgatgctccctgatgaccagttttactgggtgtgcacaatctgtcttccccactggactggaggagttctgagggcatggggtgtgtcagtcttgcttgcttctgtatccttagcacctgtaaaagtgacaagcaggtacatattttgaatgagttgttcattgagttgaatgaatttgtgctgtgaatgttgatcacactctttgtactttcaaattattcttctgtcatccatgactgccggtggcaacccccatacccccaatctagatcagtctttgaaagattaagggagcaatgcttgtgaattgaccacacagctgtcttttgaaaacattatttatatgtttattaatttttcaatttgcataaatttagaggttgcaagtacagtttccatacatcatgggtatgttgcatagtagtgaagtctgtgcttttttttttttgagatagagtctcactctttcacccaggtgggagtacagtggtgtgatatctgctcactgcaacctacatctccaagattcaagctattcttgtgcctcagcctctcaagtagctggtattataggtgtgtgccatcatgctcagctagtgtttgtatttttagtagagaaagggttttgccatgttggccagcctggtctcaaactcctgacctcaagtggtctgcccgcctcagcctcccaaagtgctgagattatagggatgagccaccatactcagccaactctgagcttttagcgtaaccatcaccttaatagtattcattaagtaatttctcatccctcaccttcctcccgccctcccacccttctgagtctccatagttcatgctctgtgttcacaggtacacttcatttagctcccatttacaagaactacataactcttaacaacacatttgaccaatctggcttcagtttcctgattacaatactgataatgaggaattgaactagaatggagtgtcaatttgttctcacattgctataaagagatacctgagactaggtaatttataaagaaaagatatttaattggctcacagagccacaggctgtacaggaagtatgatgctggcatctgctcagtttttggggaggcctcaggaaacttacagttatggcagaaggcagaaggcaaagggggagcaggcacatcttacatggccagagcaggaacaagagagggagaggaggcaccatgcactttaaacaaccagatgttgttacaactcattcattgctgcaaggacagtgccaatgggatgttactaaactgttcatgagaaactgcccccatgatttaatcacctaccacctggctcacttctgacgttgaggattaccgttcaacatgagatttgggtgaggacacatgctctatatcaaatggtctttaactagggccccatctaacttcgaatttagaaagcaaatgagatatagaaactaggccacagaagagaaggttgaagggaagtatcattatctcagcaagacagagatggataagttacgaccagaagcagtcagtccctccctggcccacctgtgtacagaaattagcccattttctcttgacaggagagtgtactatgtagctaaattaggtttgcaactaaatcagtacagacattttgctttctctttgctataatgagaaactaatattaatataatttgatctacattcatgggttgtagtaacgaattacaggaaaggtacccaggcatggtggctcatgcttataagcccagaactttgggaggctgaggtgggaggatcacttgagactaggagtttaagaccagcctgggcaacatagtgataacccatctctacataaaatgtttaaaaaattatccaggcatggtggtgtgcacctatggtcctagctacttcagaagctgaggcaggaggatcacatgagcccaggaatccaaggctgcagtgagttgattgtggcactgcacaccaacctggaggcagcaaagccctgtctgaaaaaggaaaaataaactaagaattatggataatgaaagcaaatttcacctgcattcaccttctattagctttaacacctatgaggtgaaatctttgtatttatcattatcgttcaccggttaccaactgaagaaaaacagtaatgatatttctgctgaatcccttcatttaaactaaagagtagctctgcttgctgtctcagctcaacctgaggatgtagtgttgttttctgaagacattagtgaatctggaatcacctgattcctactggtggttcctgtagaagactatggaagtcacaaaggatgaaccaaaattttggtaaaataggctggttaatacgatatggaaacaggaatttggtttttccaaattcaggaggctagaatttcttcctacttttgagaagctccaaagcaaaaaaacacaaactttgtccatgtatagatggccagaatggttttattttcctaaaatatatgcctagtttcttttgaattcaggtggttatttgcagatccttgcttcagaaaataccagcccaactccatgcctggcttacagttggtacacagtaaacagtaacaatgattgctgttattgctatttaaaataattatgtgctgagaagggatgtcctctcccactgactgacttgtgtgcgtgagtgtgtgtgtgtgtacatgcatatgcattggcagaaaatcggttaactcttattgaacctcagtccctctgtttaaggagaataaattgtcttgcaaaactgcatggtggtacattctagctcaagttgctatgacattgatatggaagtcaacatgcttatcttggtaatgccatcattccttccttccttcattcattgattcattcataaatagctatggaaaaattttgattttggattctcgctaggtactgaggatatcatagtaaacaaacagatatggtgctgtacactcatgataacattggaagataaaactttaaagtaaataaaataatccatgtgagattaactatcacagactagccaataccagggagggctcaggaatgtaaggatgtgattagtttgaccagatgtgagagaggaccaaggagtatcctagatacaagtactttcttctctttctttgtcccagcccaggttttctcctttctaatctagctggctttcttcatccttctcagagggcattctcctctcagggttgtttcgtctcccagcaatgaccatttacgcttcacagggacagactctcccaccaagtccataaacctgcactctgtgcagaatcattgcccatttacagctgctaatgcattaataacagaaacgtccgtggccatgacctacctgagtcattacacactaatcataggaggcaatttcaagcagattgactagtgatcggtgtcctccctgacgtccaggcaggaggacacacgactgccttcacaaccccagagcagatggcccgagagcataatcacacactacagccggtgcaggtgtggctccaggaagggaaatctccatgtcttgcatgcaaagctgggctctctcacctggaggctgtgctccaaatgctcgtctttcattttggagcagaatccacatctcagggaccttctttgtgctcgttttaaacttatcacacagacagctctctgaagacatggaggaaatgagattcacctgcacctgaatggctctaacatgcaccactgtccacaagccactgtcgttccttctccactttcctctgcaatcccagtccagatgtatggtccaaagctgtggtcatcatgggcttgtgatttgtgttattatttcttccctgaagctgcttaagcattgttttttattcatgttgctctctcattccctgcgatcatcattataatggccacacaatataacatcaggatgatgtttttccgctttatcttagaatatctagtaggtttctgcttttctcactaataccagaatcactagagttaattacttagcacctatagagttttcatctttgggataagtgcctgagaagtataagtcaaaggatagaagcatctttatgactttggatatatttttctaacccattttttaatggatttgctcatttacagtcagttcgttgtattttgggctttctgctcttagctgcctattgtttatttgcccataatgaggactcagattatatttaagaggaactaggcaatgactttgcaattaggagtcaaatagaatctataccttcaagaaacagaatagagagggaatcttggttagaaaataactcattgctctatgacatgataatgtccaagaaaagaaaaaggagtttcagaatacatagattctggtgcaagacatgatttctatacagattcaagccaggagcctctcttcttgaccgatctgagatgaatgccatgttatttcttgacaaaggttaggaaatgaggggtctaatggctcttcaatcccgtgggttactgttctatccataaattcatgtataagaactttgttgcatgcaccgtggtcccagtctgcttttatggggcgtacactcagaagacagcttctgaaaatgatctgggtggaaacgtataaaggttgtgcattgccaatttgcagttgcaaaaatctggaaccagccctaatgcccatcaatcaatgagtggacaaacaaactgtgacacaaacacacataatggaatactactcagccataaaaagaaatgaattagtggctttttcagcaacctggacgggattggagactattatcctaaggaagggaaaacaaaatatcgtatgttctgactcataagtgggagctaagctatgagaatgcaaaggcataagaatgatgcaaggaactttgggcactggaggggaaagggtgggagggggatgaaggataaaagactacaaactgggttcagtgtatactcctcgggtgatgggtgcaccaaaatctcacagatcgccactaaagaacttattcatataacaaaatgccacctgttccccccaaaaaccgatggtaataattttttttaatgttgtgcattgtgaggccaaataagctaggattatttttgggtgtatatgctcaatagaccctatgggtcacatctagcagttcattaagattcaaataaacaaagcagcagtcccagtagaaaatgcacagccttggagacaaccaaatgaggattcaaatcttggccctctattcactatgtatgcaaagtaggaaagttacttaatccttctcagctccagtttcatcttctctcatgaggatggcaataggaaaccataggtctcttgtgaagattaaataaaaattcctttttgggaggaggggatgcctgttagggataaaccttttactatagagaatgggacccaaggagtatagcttgggcagtgatcatttcagcaaaagggagtcgtgattactgctctgctgagttaaagaaaaccttgtgctctgataaggaagaagagagaagagagaaaatgaaagacaaggatccaaccaacaagtgggtgggaatcagatgtctatgtgaaagaaagagtccctaggaaatcagcagctggttctgaagttcaatttgaagtggtttgctgtgtggtaaaccaatccccccgactctgtgtgcccttttctacccttccccctgaagttaatctttcctttcaaaactcatactcataatggtttgagagtgatcatggatggaagttatttcaagtgctgaattcctacctgactccatgaagtggaaagcagttgttgttcctagtcattcttaagataacagctaacatggtggaagttttgcttatgggccaggctgtgtactaagaagtttacaagcatcacctcatttcatccttataatgactgagtgagataggttctgctaattattactcttctacagatgagaaaactggaactggaagaggatacatagatttcttaaagttagacagcatgcaaaagctggagctgagtttgaattccacccatctcaactgtggagtctacgctcttgaccactatactaaactctttctatatgcagaactctgagacaaaagttccagtgggactgtaagtctcatcaaagaaatagtgacaaaggcgattgtcttcatcaggaggtggccttgaggattctggtgcctggagacctcagctaatgtctgggttatatttacaactccacttcttcaaaagatggatgaaggccaggcatggtggcccatgcctgtaatcccagcactttgggaggccaaaacgggtggatcatttgaggtcaggagttcaaaaccagccaagccaacatggtcaaaccatgtcgcttctaaaaatacaaaaagaaaaattaagtgggaatagtgtcacacacctgtaattccagctacttgggaggctgaggtaggagaatcacttgaacccaggagacagaggttgcagtgagcccagatcacatgactgcactccagcctgggtgacagaagtgagactctgtctcaaacaaataacaacaacaaaaacaaaatcaaaaaccacaaggtggatgaagttgatgactggtatgattttaaaaatattgacttctactgtgtagctttccttcatctttcccttcttccccatgcaaagaaagatgaagaacatgagcacactgtacaataatgtatgtctgtagtttaatactacatatctgtagtttaatacttagtatgcaaatattctaataaaaaagtcataaggatagggaagtaaaggaaggagaactattctaaagttcaaaaataccttattattcaaagcacatggtcttactcctgcgtagtggtggctgaaacagattgcaagctcctttcctaaggctgactctgcaaacatgaggttttgaagaacttgaaggtttcacacctgcacaaaggctcccaagaagccttgcacagcagctctcgtagtactgagctcaaagtcactgatgattctgttcaaaccctctagtccccactatgaaggctttgaaaagggatatggtgaaaggtgaggaatcagaatagggcccctaacattcctgtgatgctcttcctcatctcttccttactggaattgctgtctcactatatcaagcagggaactacagcaattcattcattcaacaagtacatagtgagtgctcttctatgctaggcatgtgctagccgcgagagacacagtgggaaaaccagacacccatgctgcctagactcaggggtcttactttctctagaggaaacaaatattagataagtaactgtacaataaaatagtataattacaaatcacagtgagtgctgcaatgtaaacacaccagcgtgtgataagaatgtatgcagtgtgtggccatttaatgtaggtgatcaaggaagtgatatttaagtggagacattctagggcaaattctctgggagaggagcaagacttcggtggttttggggaattaaaggatggtatggttagaacagaatcctagaaggggacataggatggaattgaaagagcagatatgagagagattaccatcaaggtacagacttcagattttatcctaagtgccttgggcagctcttaagggatctgaaaaagtaaggaagttagtaatacttgtgtttttaagaaagtattgatctggctactgtgttgaagaaggcttgaagaggaggcaaaaagaacagttaagtgggttattgaaatagtctggggccgggcccagtggttcacacgtgtaatcccagcacttcgggaggccaaggcaggtggacgtggtcaggagtttgagaccagcctgatcaacatggtgaaatcctatctctaataaaagtacaaaaaattagctaggcatgctggtgcatgcctgtagtcccagctactggggaggctgaggcaggagaatcatttgagcccgggaggtggaggttgcagtgagccaagttcgcaccactgcacttcatcctgggtgacagaatgaagaaaaaaagtctgggagggaaggatgacattggcttagaataggggtgagttgtgggaatggatataaatggaaggatcctccattttctgtttctctctctctctctctatatatatatatgtatataatatgtgtgtgtgtatatatatatgtgtgtgtatatatatgtgtatatatatatatataatctatctgttaatctatcttctgttttctattcagtgttgcataaatctcaaccatttgctcaattctctggtgcatcagagagtgccaccagtatgtcctaagtcctgcagaaatcatgcaattttttttgtttcacctttttttaaaaaaaaaaattgtatttatttgtgtattgccctggaaatgtacaaatagtttcttcttcccctattaaagtttgcttggtggggtcttgctggttcctgagtttgccttggctgccatcttccatcctacctaggatgacaccatttgtttcacataagtttctcatgcatgagaggctgacattcttaatagttctgtcactcctgttacaacaggctgctgaaaagaaacaagcgatgcctgcaggagatagggctgtctcagcggtttgtgtaacaccaatggggtgtgaggtagcaggaaaataattagtttagttagatgtaaatggaagacgaatgaagaaagtgctaatatgtggatgcctgggagaaggggtggcctgcctcatttaaggtttgaggaagaataattgaatgaatagctatgaaaatgaaagcaatattaagagacttgtatggcaacgtagaaggcgggaagagctaaattcgatcaaccagcatttactgagtgtttattatgtacctgtcactgtgtgaggcattttagctacactggtgggaaaaaataatggtaagacataaataagactttagaatctccgtggaagtcaaaatttcagaacatatgaatgcacaaacagatattagaaaggttggatagcaattgtaagctacattaataggcaaaactattagggatggcaggaataatgttgaatataggagacatgactgactgtgacgatagctagttgatttaaattctcagcacattacttctttccttcataaaatgttcatgtcacagcatagcgtgctgttatatcttcatacacacacatgcacacacatacacatacacatctggtcaaggcttgtgaggccacattaggggttctgggaacaggaaggtagtggagaaaaattccctctcctaaccatttagtgtataggagtctactgttttagtgaatagttcagagaacttaaaggtgttcagagaagagaaagtcagcataaaccatgccgtggactagaagggtagatgaaaggtgttggaaaaatgtagagatgaatccttcattgatgatgcccatctcttatgaaagttatagaacatagatgatcaatatattagctacaccttacagaacatgggccattctaacagatcataatcattatttaatatcttactgagagttttgattgtattttattattgatccaatgtcatgttttgatgtccttgacatgtgacattctttttttttcttttttgagacagcatcttgctctgccacctaggctggagtgcggtggcatgatgtcccctcaatgcagcctctgtctcccgggctcaagcaattctcctgactcagcctcccgagtagctgggactacagtcatgtgccaccatgtccagctgatttttgttttgtatttttcatagtgacagggttttgccatgttggccaggctggtcttgaattcctgagctcaggtgatccacatgcctcagcaccccaaagcgctgggatgacaggtgtgagccactgcgcccagccagacattctttcctttgctatactctttcatattgtttaaagctgttttgttctttggatctgatagttctgttgttttagtcctgagatttctccatttcttttctgctttttattcagtgttttttcaaatctccctttgtcatcatagcttctctttgcctcacattcttttctatcacttgtcaaatttctcatcagcttttcatccttgatttttcagagtttggtttacgaaatggtccagtcatttctacacctctgaaaaactcttaaaattaaaaaatatatatatcagaaatggatacaggcttattttcgtggatggacttaagtttagaataggtggcatatgtttaagtttttagatcacagacattaggaattggcttttaaaagatgttacatcaacgaatggttagaaagcagtaacatcttttctacaaagatacttgtcatctgtcagatttatttatcagttaataataaagtgatttttcatatcactagatgattttctactgtctcattagttgaagaaatcaaaagaaagccaccctatgctaactcatagaagggcataactatttagtaccccgagggccaaagaacaattaaagtgaattaaaattatttcttttttggtgggggtaggggggagcaggaaacagaatgactagactccgaaggatttttctagagaaatattttaaccattgagtaaattttccttgattaaagaaggaaataacaacttggagaggaaatctaagtattactttagggttattgagagatgccggctagtggtacttggaaagataaggacaacttgtcagccactccacagagaagtagttttattaaaagtcaacgaaagtggccaggtgtggtggctcacgcctgtaatcctagcgctttgggaggccaaggtgggcagatttcctgagctccggagtttgagactagcctgggcaacatggtgaaaccccatctctactaaaatacaaagaattagccaggcatgttggtgtgcgcctgtagtcccagctactcaggaagctgaagcaggagaattgcttgaacccaggaggtctaggttgcagtgagccgagatcatgccactgcactccagcctggacaacagagcaagatagcatctcaaaaaaaaaaaaaaaaatcaaagaaatatgctagaatcgtcattatatattgagaaataagattcaatatcccatagatttaggcactcttcacatctgtgtatctggattgggtcatagggagttttattccaggctgagtgaaataagacagaggacaggcaagtagatttcttcttgcttgccagttctcattcgcagaggatccctgtagttctgttgagaattcattggaactcagccggaaagtgctgagattgattagcaatgtcttccatgggtacaggaaggggaggtggcaggtaacatatataccagcttttgccattctgctctagacagaagaaacttttcccctgtggtcaaagagggagagatatttgcttctggagactggatctacttgggttggtgaatgcattttaagatgacctggtttcatattactgtcaagcaagagagaacagtgtcatcctataatgtcaggagtaatgttacagttcagttgggaatacctattatgcctgttagtatttctaactaaatcccctttcgatgtgatagtttaattgtaggaacatttttctgcagttttgtttagggaatactgcttgcttagcgcttaatccatttatactattggattctgttgcaaatgacactcacactggaatgtgtgttagacacgtaaggcagacgggaagatggttccattcatttcagagaaatgggaggcaaaagtgagtaggatggctttgaaggtggtggtcttatgtttgaatgcgcgtcaggccccaggtggtaggtcttggtactgcatgctgctttattcatgcatctctctaaacaaatacgtcctcagagaagagagccaggagagggaggaagttctagaaatgtgctattggtaaatatacctaaagacagtggcatttctttaaccatgttcatcataatgagaaatgcagtaaatatgaaaataaaaaatcaggccgggcgcggtggttcacgcctgtaatcccagcactttgggaggccgaggctggtggatcacgaggtcaagagattgagaccctcctggccaacatggtgaaacctcgtctctactaaaaatacaaaaattagctgggtgtgttgacgcgcgcctgtaaccccagctacttgggaggctgaagcaggagaatcggttgaacccgggagccggagattgcagtaagctgagatcgcaccactacagtccagcctgggggatacagcaagactgtctccaaaaaaaaaaaaaagaaaaaaaaaagaaaagaaaagaaaagaaaaaataaaacaaaaaaatggaaaatctgtagtaaagtcagagaacctgcattgtgatatttcctatgtccatatgtccatcattgttctccaggtattgcctggttttccagcctcacagtaggcagtgggtgagagacgcagcatgatgggagaatgaagcccattcatagtggaatcaagcctccatctttgacctcagtctgtgaccttggcagcttcttgactctgtgagccttggtttcctcttttggtaaatggaacaacaaatggatacttgcaaataagaaggcttaaataactgtgatatatatatattcatatatatacatatacatatatatatatatatatatatatatatttttttttttttttttttttttttttttttttttgagatggagtctcgctctgtcgcccaggctggagtgcagtggcgagatctcggctcactgcaagctccgcctcccaggttcacgccattctgcctcagcctcccgtgtagctgggactataggcgcccgccaccacgcctggctaattttttgtatttttagtagagacggggaactgtgatttatttttagtctcagttgaaatggggaccctatggctctgagaagtcaagacccactggtaagtaaatgtcagagctagctttgaacttcagcattcttcctacagagctgatatctcatgatgtgctgtagagagggctggatttataatctagagagggctggatgttgattctaaaactagtgcttcagttccagcctcatcacacaccacccgggagaactttgccagttgtcaacttccttggcctctgtctcctcatctctgaaagccataagattctgtaaagaggtgggggggaaattggatgagatgatagatgtggagacagtttgcacagcaggacaggctatgcagtgggaaagtaccactgtaaggaagactggatgtatagctgcagaaggtcagagaagacatagaaaatcctttaacacctgagtgaaaacgatccatgacaaatgaagttacttcatttaaaaagagcctagtcagagttttatcatattcaagaaatatcatttattggcaatctactatctgcaaaatcactgttcgagtttttctttgtgatccagagcagtttacattgcaacccttattctaaaggaactcaaaatggcattgaggaaagcatttttcaatctgacccattttttggaacccaagagttcagagcactttatattactcgacagtttatttccatggagggagtctataaatgctttatatttatccatgttatgaattaatgcatttctgaagaaatccacccaccatgtggcatgttgattccccttttctctcatttcccccaaaacaccaaagaaggagggccctatgaggttcaatggtctcctttaatggtgcatttaaagtcgacatgctgatgccaagtctttctgtattgtgccgtcccaacagggatggcttcttagcagcgaatatggggtgagtaatttgaatcaccgccatcaacctgaaaagccaaagttgttccaggataacccaaaccagaacaaacctcagatatttgcaggtgaaagaacgagaatacgaatatatgttgtgggctgggagagccaaaatggcaaaggagtggaaataaattaatggggggaaatgattgatgtggaagtaagtctctcaattgtacacctggatgccacattcttacaagcagcccagtagaggcagatatataggctacaaagacacgtgctgtcaagcagcaagcactacttattgtctctgttttctctctaattgatacgtgtcttaggaaagcttaggtaatcacttggcaaaacacatctttataagaccatctctgtaaaaaaaataaaagtattaaagtgacagtggcacagaaaatcataagaaaatttttccacgttgagacgaatcctcctgcctcttcttgagaatccctccaaagatatcctgtatgtctgccttgtgagaaaacacccccttgggtacaaactggtcaatatcaggaaggcagcatgctcatatctcagtcccaatgcatgccaaatcactaagtggatggcattttcacaaagtcagaaaagcgacagttttattctcaaggttttgttactatgtttcatgatgtgcaagcaatactttggacaattttatccagatggttttgtccaggtaatttttgtctgcaatatgtgaaatacgtgatattctactatcagatactttggattactgttttttagtggtgagaataaaaagataccttcattttccattaagtattacattttatgaatattttccccacctcttcacttgaataccttcccactgcaacacacacacctacacctgtattccttttgatccataattataagcttttgaagggattatatcaagattacctatttttaataccatgttaataattagacaacttgccaatgttgaagtttgttaaggtcctctccatcacaattcctgagctaattactagaatatcagtcagtaggttctaaatcaaaaactctgggcgtgtgcctagatggaaatctgaatttttaataggcagatgagttgatctttattaatagtagtttgaaaactaacacagttcaagcaaaaacaaattctcatacagttgagcactgggactaaaatatttttttaaaaacttggtcactggatgaaatctaagttcttggctttctcttaaagagtactttaaaggttagaaatccacaacagtggctacctggttatgtaattccaaattcattcctcttctaagacatacaatggcactcaagagacctgaaaaagttagttcttcttcaaagagtgcatgtttaaccaacttctcaaaccaggtgaccattattatgttcactttcaaaagtacggaacaatttgaacctgtagaaatgtatccaaaggaacttaatcttttattttgtggtaggtacacaataaaagttttcttcattgaatgaattagtcaagaactcattctcataatgcaggagaatgaaatgggaaggggtgaggggtggcatagctctaggagactggcatgattacagatttgggtaattcccaggatccagtagcctggggcagacttagacaattagatagaaggatcaggagtggaatggaatatggcaagaaatgtatgtgcatgcagtgaaagcgggcagaaaacaaaactcattgattcattaaatgaatattttatggaatacttactgtatgccaggcactgtgctgctgaggaaggccaagttgacagagtaactggccatcccaggatttccacaattgaggagtgtccttagaggtgggactttcatactaaagccagggaaatgccaagcaacccaacctgagtcaatcatcttgaacttgaagaagtgctgtgattttaataggtttgttgcctgatgtgtgcagcaagtcaataggagacactgggttacagcagagaaagtggtttaattatggggctgctgaacgaggagcagcaaacatcaaatccatctcccggaggagctgagggctagggttcttggagagggctaaaatgtggagatcattcattgatcaaagaggtcatcgtaaagtcatggacagggaggtaaacagtattctcatactgattctgttcctctctgggaggtctttaaactggttggcatcagctgtttcactggaatgttggatttgataaacatcttaagcgattcctttattttttattttattttattttattttattttattttattttttgagagagtctcgctctgtcacccaggctggagtgcagtggtgtgatcttgactcactgaatcctctgcctcccaggttcaagcgattctcctgcctcagcctcctgagtagctgggattacaggtgcctgccaccatgcccagctgatttttttttatttctatttttagtagagagagggttttaccatcttggccaggctggtcttgaactccagacctcatgatccacccacctcgtcctcctaaagtgctgggattacaggcatgagccaccgtgcccagcccatcttaagcaattcttaaacaaaagctttatgattctagtatcagaaatcctatgtacaggaacaatggggatgcaaaaggttggtatctagtgactttcagttagaaggaagtggaacaaagtgcagcctgattaatacttaattatgaccatatttctgcccaaaattcttgttaaccatgtgaggatggcttcagtgctaacaagagtgatgaatagtatgggtgctaaggggtcacgaaacaggccgtccgactatctgcagcaaggggacaggaagtataggggttgggggagagttaggcctagctcactcatgacctaaattagttactggtgttaccgaaaatgggtttggatccagactctaagacagggttcttggatctcaagcaagaagtaatttagggcaaatccacagagtaaagtgaaagaaagtttcttaggaaagtgaaggaataaaggaatggctacctcataggcagagcagcaacaagggctgctggttgcctgtttttatgattatttcttgatgatatgctaaacaaggggaggattatttatgccttccctttttagaccatgtagggtaacttcctgacgttgccttgtatttgtaaactgtcatggcactggtgggagtgtagcagtgaggacaaccagaggtcattcccattgccatcttggtattggtggatcttggcttctttactgcaacctgttttatgagcaaggtctttatgacctgtatcttgtgctgacctcctgtctcatcctgtggcttagaattccttactatctgggaatgcagcccagtaggtcttagcctccttttacgcagcccctattcaatatggagttgcccttgttcacatgcctttgacacaagagtgagccagggaaagagagacattcaaaggagaggtaacagcacttctggggacctgggggatcacaagcattaggaaaaccagaagaaaaaaggggaaggggtggacagagagtggcacagaatgaagccacagagatgggcagtgtccactgtctctagggtcttgtagggcatgtgtaagctttccactgatgctgcatcaaatgatcacaaatcattgatttaaaaccatgcaaattttctgtcttacagttctggaagttaaaagtctaacatgggtcttactgagctaaaatcaaggtgtcaatggggcagcattccttctgaactctctatgggaaagaacctgtttccttgcttttttttggccactagaggctgcctacattccttggcttgtggcgtccttccattttcaaagccgacaatggcaggttgagtctctttcacatcaaatccctctgatactgactcttcttttacctcgttcttctccatcttgtataggagatgagtaaaaggaggttgagacttcctgggcggcattcataggaagttagggattcctagcctctagatatttacagttaagggaacagattaataatgtttactaaacagacccaggctcagaatgtcctgatatccccatatcttgaaaacaaaaggattcctaattttgctttaaagataataatgctgattcttgcaaaatatagtaattaagaaaattaatcctttatcacaaaccctgatagtaaagcacatcttcccattttttttttgttatgctgtatataaacaagcattgtacatagggtggctggtttcctcctcttacattatgaatgtcctactctgtctatggagtagctgttatttcaccactttactttctaaataaacttgcttttggtttgcattgtgggctctccctgaattctttcttacacaaaatccaagaaccgtttattggagtccaaatcaggactgctttctggtgacacttttaacgattctcgtgattccactgaacccacctggatcattcagaataatttcttgcgtaaggtcaactgattagcaaccttaattccatctacaaccttaattctcctttgcaataaaacataaaatacttacaggttccaggaagtagcatgtggacactgttggggggcctattattctgcctagcacagggcacagtaaggattttgtgcaaattcaaacaggaattggcaaactatcaaagccctgctttgaaggggagtgatggtggtcaatttgcatttcaaaggatcactctgctgcaatgtgggaatggaggcaagcttgtgtaagggattatcagttgggaagctgttgcagagctcctggggagagatggcggtggtctggactaggatggcaccacgaagatggacatgtggaaatgcattctggctatattaaacagggagaattgacatgaattagagatagattaaaaacaagtagaaacgaaggatcccatgttttgccatggcaatcttttcacattgaatgaatacaaaacgtcaaggtgcttagcatagactagcccatgaatggcacataacagaaacaaccttgataaggttcctgtctctaaatttaaagatgtgcacagcaacctcacgagattcaaggttgaggcattgagggtagaagaagtaatgaagttaggtaggttttgctgagtggcatccacgtggatgtctattagagagttaggtatacatatctgaggttcagaatgcacattcctgtccatttcttccaaatataacctttattcctctaaatgctttttgtgaaatgtgtttggtatttgataaatctcttcggtgcgtatctccaaatttggagataggaaccttatcaaggttatttctgttatatgccactcacaagctcgtctatgctaatcaccttgacattttgtattcatttggtgtgagaggaatgctttatcctacattgatggggacacttgtttctaatgagaaatctgatgaaatcaggtgctttgaatacagatcatctccaaacttctgtcgctttatattttttctgaagtttgtctcctccctttaggagaccatggtttttgatacgaaactccatctgatagtcatttctgataaggattttacttttaaatccatcaaaagggaggagaagtgacaatttaaagtgggcagatggaaaaatgagtctcttggtctttctttatttcttatacccctcttcctctctgttcttttcacaaaagatagtctcatcagaaattcggggaaaaatggcttttcattcttattctcattttctgacattcttactctacagtcattattaatgtagaaaactctgtctattaggtaatctgtgtcttcccctaccctggtggtatttcattatcatttaaatatgccacccactgctccttctcaaaccttttgaatagagggtcattagtagatttttccccctaaattatgctcagcagttgttaaaggaagatagtcttcagggaagttctttctacattgaagaactgaagtgaggatttgcgataattatctggataactcagcctcttcttatccctcctgaggtggaacatatttcctgttctctttcattccttccttctttcatttcttatggattatctttgccacaaacaacaacaataataaccaaaacaaaaccaaataaggtattcatgtttccatgcttcctatagatgtagaaagtttttaaaaagtgttttttgaattgctagctactgtttaaaaattaatacaaatgcatgtcaaacttcctatgagacattttaaagcaggactcgtcttgagatttgaatcagtcgtctttctcagtcattttgggggattaattctgtgttttccatgcataatattccctttggattaaggattactatgaacctgggctttgtcttcatccttaagaatcaccatcccctgagaattaaagatgatgcttctcatgtaaattgcttgaggttttcacgagtctctggctgttacaaatgtcagctgagcacagtctaattctaatcttagcagagtaacctctcctgggcatcggagactgtgatgaaaggaggtaatcagtccttcttcatctctatttctcgtacccagtgccacctgatatgcatcatggaaactgttgttggaggatcaatgtctaggagaggcactgcttgatcttatgcaacctccacctcccgggttcaaatgattctcatgcctcagtagctaggattacaggtgcctgctgccacacccggctaatttttatatttttagtagacacggggtttcaccatgttggccaggatggtctctaactctgagcctcaagtgatccacccaccttggcctcccaaaatgctgcaattacaagcatgagccaccatgcccggcctggtattatacaattacacaatctttccttctctcttcttcttttttcttttttttcttttttttttttgagacagagtctctatcgcccaggctggagtgcagtggcacaatctcagcgcactgcatgctctgcctcccgggttcacgccattctcctgcctcagcctcctgagtagctgggactataggtacccaccactgcgcccggctaattttttgtatttttagtagagacggcgtttcagcgtgttagccaggatggtttccatctcctgacctcgtgatttgcctgcctcggcctcccaaagtgctgggattacaggcgtgagccaccgagcccggtttttttttttttttttttttgagactgctctgtcgccaaggctggagtgcagtgatatgatctcggcttactgcaacctccaccacctgggttcaagcgattctcctgcctcagcctcccgagtggctaggattataggcatgtgccaccatgctccactaatttttctatttttagtagacacgaggtttcaccaggttggccaggctggtcttgaatttctggcctcccaaagggaggattacaggtgtgagccaccgagcccggcctggtcttacagaatctttgtgagcatcaagtctgtcatttgtaaaacaagaacaatatatggcggcttttagggtgttatgatgatacagtaggatgagatgtttggaagagcaagacactagattcttgtgaagcaaagcattctcctgtttgccacttccttgttctctcctaggtagacttaaacagctcctgctgcagagtagatgaatccccacattggcgctgcgtccaggagggttcttggctttacccagaagagaattcaagggtgagccaggtgtgttaaacagtaacttttattgaagcaactgcgtactgctccttacagagcagggctccccctataggcagtgtgcccagaggcagttctgcagcaatatttatgcccacttttaattacatggaaattaaggggcagatgatacagacatttctaggaaatgggtggtcatttccaggtgttgccatggcagtggtaaaccgacatggcaggctggtgtgcatgtctaatggaaagctgcttctcccccagccctgttttagcgagtcctctatccgacctggtatgggaatccccacatccagagtcagttgccacctcctacctcacttccatcatcctttatacttactcggtcccagctacatggcagacataatcctaggtgtgaggatgtgttgggagcaaactcgagtttctcccttcatggagcttacattctaaaagagggatcagatgttgacacatgtgaacccatacaatctaagactggtctcagttaatttagaaagtttattttgccaaggttgaggatgtgtgcctgtgacacggcctcaggaggtcctgacgacatgtgcgcaaggtggttggggcacagcttggttttctacattttagggaaacataagacatcaatcaatacatgtaagaaatacgttggtttggtctggaaaggcaggacaactcgaaacaaaggcaggaagactcaaagcggggagggggattccaggtcacagataggtgggatacaaagtggttgtgttgttgagtttctgattagcctttccaaaggaggcaatcaggtatgcatttatctcagtgagcagagggatgactttgaatagaatgggaggcaggttggccctaagcatttcccagcttgacttttccctttagcttagtaatttggggggcccaaggtattttcctttccaacacatatgcaagtgaatacttattatatatagtgccaataatgagcccaaaacaagcaatccatctgagagaatagaagcggccagaaggtactgctgtagatagtgttgttaaatttaactatatttggcctgaggatgcctctgtgactgagtccttagttaacaaactacagcctaatttagtatgtgaactaagtgaaagcctaacttgggaatgtgagtctgtaacaggttgctgagtctcagccaatcacggcagctcagcttcagataatcccaggcggccaagggatcaggtactgttccaacgaggcaaggctgatctgtaactaatcaaggtgcttccctacctcacttctgttttctgtccataaaggctgactgcctgtgttgaggagtggagctctctgaaactcttctggttccgatggcagcctgattctcgaattgttccttgctcaattaaactctgttagatttaatttgtctatagtttttttattttaacagtgtcttgataatgcctcaagaaatgcctttttgaggttatgatgttggagcagagagttgaaataacttcgtaattgaggcttgtcttgggatggttgatgttagtcatgtcaaacgctggatctctcatatattaccagaataacctcttgacaagacagagttttctgtttaactgaattatgggagagcactacctcaacagagtcttggtggtgttccaggaggatgggcaaattcaggatatttattgagatttcaatgtgtgttgtaaggtgggtctttccatgtacagccttgtttacattgaataaagatcatgatattatagtttagaatagatggacagagcaaggcaaggatattgggctgaggagttcaaagaatcttagggtgaaagtggccatttgatgctttctcttcaagagtaagtgggtctctgaagaagttcctggaatgggcaataaagccatttggacttttaactttctggccaagagtttcctggaatagtaaagtgatgtgaagaagagagtcaactagggaagtcatggtaatgtagacagtgaacgggagatggttctcatcctcaaccaccatcatcatcattgtctctcctctttactgggggcttcatgtgtgctgcatactatgcttggttctaaagatacagctgtgaacaaacaggcatgttcctttcttctcatttggcttataatctacccgtgaaggtagatgctaaacaaatggttgcatgagttaattacaaatgcaatagttgctgtgaaaagaatgttcttcactatgacagtgtagtgtcaatcatggggcgctgtggaggcctgggagtaactgagagaggctttgcatcttgcatatgcatagatgctagctgggtgaaggacgcaagagacggttgggtgaaggagactgaagtttatcttagagcaaggagaaacaaaatgtccctgtatatcaacaattattatatcctatgttcacagagaacttgacacaaataatatcataagacacattcacagtacacagtgacagtgcttggaaacatcaaaattgacagtctacctgcgactgcctggcccattcctctaactaaacagcagttgtttgttgaaagaatgagtgaatgttgaattaatcaacaccatttagttcctcagtgacctccaacagctcatttgctcatgcagatcatacagaaactggtgagaagacatgtttgcatctcagcctagcttactcctgaatacaagaaagcaggaaaacaggccttcaggcgtgaaagtgggtggtggaaacccagcccgttcatacctcttggtcaagtttagctatcctaagtgtgggaggcagagaaggggaaagaggcaggagtgctctgagggaggttatagctttatgggtttgtgtggtttgaggtctttgctcttggttttgagcactgtaggagaggagataggcttgtgataaaatgtggggcacatgtggggtcaggccatccaggttcacactccagctccactgtttaggagctgtgtaaactcaggcaaatcatttagttccttcttgtctatttgtctcctctgtaaaagagagatggtatagatgacaccatatgcttcttggagaattgaatgagatacttcagtagaaagcacttatacagagacttatatggcatttctatggcaaatgctgcccttacgtcaggggaaatctctttgccctgttgtagtcctactcatgcttggtgagatggtatatcagcctgttcttgcactgctataaggaaatacctgagacggggtaatttataaagaaatgagcattaattggatcatggttctgcacgctgtacaggaaagatggcagaatctgcatctggggaggcctcagggagcttttactcatgacggaaggcaaagcaggaggaggcatctcagagcaggagcaggactgagggtggggagcgtgccacgttcttttaaacaaccggatgtcccgagaactctctcaggagacagcaccaaggggatggtgctaaccattcatgaaggatccacacccttgatcccatcacctcccatcaggccccacctccaacactggggattacaactgaacgtgagatttggacggagacacagatccaaaccatatcagatggcaacccaggaaaagcagatttcaggtgtactatgcttttctggggatagagatggacagaggcagatttgctcatttttggaagtcaagcgcttcaaaagaaattcttatcttgagatttgattcctgattttatcaggatcttacagcagacttcttcatggaaaagaataactgttggctaggcgagctgatgctgtgccgtgggttgctatctctttcaaattcctatctgcagtaacctctgtctctctgaggttgaaccaaacacatacttattttgagctgaattttagacaggtttagagcagccagaaaaaaagcagaaaagtgcccttcagaactcaaagcagataaaactttctgttatcccttacctagccgacgacttgagtgtagaattcactcagctgataaggaggctgacattttacctcttagaagttttgtcagataaaagatgtgcaagccatgtttaccatccactctgtgtttcaaacttttgataatagatttaaagaaaaaatcatcgagatacgaatattgtggtaaaataaagctaccccatagaattaaaataatgaggatcaaagaaaggctcaaattgttcaacatcctttaaaaggatccctttgagaaaagctgacttcttgacctatgtcattagtggttggtaaacaatttgcatggcttactaggattacactaatgttcctgactccagctccagcttgcagagagtgcaggtacagtcctattgagaacacatcttcatctctagagagcaaacctggcattaacaatgggagctaaatagaaaatcatggcatttcccatgaaaaaaagagtaacattaagtgctgggctaattgtcaagtggagggttggatatcttctccatttttccccatggttttccaatactttataggaaaaatgattaataagatatccaactccaagaattcagaggtccaaggagataagaaaggaaggcaagttggtttagaactcgtgtcttctacaggggatgccatggggggcagtggtgagcttaactgctggagatttccatggtgaatgtgcgtgtctctccttggcaaaacatgtagaaaagagacttttactattaattactttggtacgctcaagtatccttctcaaagcccttaaaatttcaaaaagtcctaggtttgtgaaaaatcatgcaattgatattggattcaatttatttgtggcgtatagacaaaaattcagatgaagaaatcgtaaaaaatacatggtgtttcacgcctgtaatcccagctctttaggaggctaaggcgggcagattgcctgaggtcgggagttcgagaccagcctgaccagcatggagaaaccctgtctctactaaaaatacaaaattagccgggtgtggttgcgttgcgcatgcctgtaatactatctactcgggaggctgaggcaggagaagcacttgaacccaggaggcagaggttgctgtgagccgagatcgcaccattgcgctccagcctgggcaacaagagtgaaactctgtctcaagaaaaaaaaaaaaaaaaaaaaaaaaaaaaaaaaaaaaaaaaaaaaaaaaaaaaaaacagtgttctctagaatatacttcccaacttctaagtacttcatttaactagttttagggaatgtttatttaactaaggtgatgcctgaatgccaacaatggcatccatacatctatgaaagaccttttactagtaaccttttaaatcacttctctgttgataatcaccaccctcttgtgagtaattactaggtcctaaagcattgtccatggattttcatatttaagcctcattaacaacactaggaggtaggtggcattaattctgttttattaataagttcaacaaaaacttaaagagtgcaagtcatactcatcagcaaggatgcctagctcacaagtggatgcatggggatttgaaccagggtctgaaaacttggaggcctaggtttctatgagggcactcttctgcctcccttagtggtggatggcctggcacctggtcctcaccacgaaatgcctgaaatgaagaccacaggcagtgggcacttggctgacaagtagcaacttgtgcaaagttgtgatatgtcatcttatcctttcagttttctcctgttgcctttcaaccacagcaatgtggccaaaacttacgaagcaggagttttatgacataaaagacataatggagtccctgtcttgacctggggaggcaggttagcttacagggaaagatacataatctttataagagaatattttcatgtgtgcggatagtaaatatacaactgtgtaattatatatatgcatatgcgtttgaattgtattctaatatatacaagaatatatataaaataatattgtatacataaaatatatatatataacgtgtgtgtgtgtgtgtgtgtgtgtgtgtgtatatatatatatatatatatttttttttttttttcttgaggcagagttttgctcttgttgcccaggctggagtgcagtggcatgatgtcggctcactgcaacctctatctcccaggttcaagcgattctcttgcctcagcctcccaagcagctgggactacaggcacctgccaccctgcccagctaacttttgtgattttggtagagacagggtttcactattttggccagggtggtctcgaactcctgacctcaggtgatccgcccgtcttggcctcccaaaatgttgggattacaggcataagccaccgctcccggcctaagggaatgttttcatgtgtgtgtatactaaatatacaagtgtgtaattatatgtatgcatacatatatgtttgaattgtattctcatatattaaatacatgttatttcagaaatggaaggcaaaataaggatattagcatttcctgaggtacgtaaaatgttgggtgctttgcacgtctgacctcatttattttacaacctacctacaagatatgcattattttcatcattccaccaatggggagtatacgggagatgctgtaactggtataaatgcacagaatttatacactgcagaaccagcatttgagttcatggctgtatttacccaaacctaccctttttcagtgcttttttctgtctgttgggcagggagagacattagaatgagctggaggtatcacagatggataaggtacaattgagagtttgtagaggtttctccagtcactttatataataaaaagcaaccagctatctcaagtcccagacctcccagccctatattctctgctttattttcctccttagctcttatccttatctggaatgttgtgtattaacttgtttcctccatctagtttataaatgctatttaggcaggggggttgtttcttttgttgctaggaccattgtacctaaagtagtacttgacccatcatagataaactatccgtatttgttgaaataatgatgccacctataatcaaacaaattcaggacaaatgaccaaaatttagtgtttatgttgaacaattatgaccatcaatgatcaatcatgaatgtggattacaatggaattttactttgaaaattttctaaacactagtttttgttttgtttttgtagcccagggaacaaaggagggcactgagagctgtgagtggagatagcaaaacaaaaaaacaaacaaacaaaatcgtctatttatcctgtccttgctttgggttaccatgcgaagtcattcattacttttagaaataattcatacattgctcaaaaaggatatcctgcgtgtttgatacaaagggcatttatcatattgaagcagctaaaacttttcaatcccatccattaactcacgaagctgcaagttactgcgacgctgccttgcccatctatttagtatttccaggcaatcatggtacagtacaaagcaatttgtttttatataatttccttcatgctcgcaaacacaacatgcatcacagggaaagccaatcatgaactaaagagaaaaagggatgatttaaagcgggagagtggttcatttgctttggggcatgagaaacaattatttcaagaggccagggtttctgtgggaagtcaggtgaataagaatgctagtgctggccggctgctttctcggagaaactgctttgcctaagtaacttcttcttttgagaggatttcttactgagccataaatgcttctaatgtgaggaaggctaaatccgcctcctataaacctgggagccatagttccatttctccccatctttcccaaagatcatctcctctaccattgaaggacaatgggaaatgctgccgcttttatcatacgtcctccatctgaaatgcacttggatttcagccacgtttgagaacctaatcttccaataaactcctttagctctatgagagatttccattaatttatttatttctgtgcttgtttgttttttgggatgggtattagctcatttgccatcctagatacctattttttaacttccttggtgttttactgacaaatataacttgtcatttatttgatttctgtaataagctgcaaagtacttatggtcccttttaagtgtagggcatggtgctgggtttaggcatggggatggtctcaggagactttgctggacctagagagccaggtaggatgggtccttaagcccaaatgcattgcttgtgggggattcaaagacttatctaagattcctttgaattcaaagggggcttgtatctaaggaccctcgatgtccctagccctttgttccctgtagtgtcacttggttatttcggccacaaagtctttgctacactggtttccataaaattcatgcaagcgaacggtgagtttaatccacgttgaggaagatctgaaggacattggagtgcccctgtctcttaaggcacagtccacatgacacgttcctgggctctggtgttcttcctgcttttcctgccttcagtgaagaacttgttcatgtcttcttttcttcccacctttagtctccttttctagaagcataaacacataaacagttcacgcctgtagtcccagtactttgggacgccaaggccggtggatcacctgaggtcaggagttgaagaccagcctcaccaatatggtgagaccccgtctctaccaaaaatacaaaaattagccaggcctggtggcatgcgtctgtagtcccagctactggggaggctgaggtgggaggatcgcttgaactcaggaggtggatgttggagtgagccgagatcatgctagtgcaccccagcctgggtgacagagcgagacactgggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgtttctttgtctgaccactcatcacctctccgcttccactctgagtctgcaccagtctcttctccacacagcagcgaaaccagtgttccaaaacgctgtcttgatcaggttgatgtccctgactgatagcttcagaggctcaaggtcaaacatctttcccaagatcaggaccaaactccttcctatgatctcgcaggcccctgccctcttcctctggctcattccccttctgtttcctcttcctgactgtatactagctgcaagagtctttcattcccttgaaagtattttgcttccttccatcacagagtttttgcacaggccgttcctgtacctggaacatttctcctccctcggtctcactaatctctgaaaccacttgtgtctgtagtctggtgatgcatcttcagtgtttaacaaaaattcatggcacttactaatagaagatgctcattaactactgaaggaatcagtgaatgaatgatcaataaatgaataaataaactgggagtcctgaggttaccgtcatcttgatataccagtgttcacataaggagacccaagtgctctgcagatatttgtcctaaaaagccataggtagttgcaggttattacaggttttcttcctctgacagcccagaggacataggagcctgacttcccagtagcaaagaacacacttagcatcctcatcttggtttctaagaccattctccaataaccccttcaaggtattgctgattacagatatatattctgtattctttttttattattagtatactttaagttctggggtacatgtgcagaacgtgcagtcttgttacataggtatacgtgtgccatggtggtttgctgcactcatcaacccatcacctacattagatatttctcctaatgttatcactcccccagccccccagcccctaacaggccccaatgtgtgatgttcccctccctatatccatgtgttctcgttgttcaactcccacttatgagtgagaacatgcggtgtttggctttctgttgttgtgatagtttgctgagaatggtggtttccagcttcacgcatgtccctgcaaaggacatgaactcatccttttttatggctgcatagtattccatggtgtatgtgtgccacattttcttcatccagtctattattgagggacatttgggttggttccaagtctttgctattgtgaatagtgacacaataaacatacatgtgcatatgcctttatagtagaatgatttataatcctttgagtatatacccaataatgggattgctgggtcaaatggtatttctagttctagatacttgaggaatcaccacactgtcttccacaatggctgaactaatttacactcccaccaacagtgtaaaagagttcctatttctccacatcctctccagcttcttttgtttcctgactttttaatgttcgcccttcgtattctatattctttcaactagaagttggtatatacaaaatgatcaggagcaacttctatttccaaaaactaatggagttttcacaaaacaaaatgggtgtaggtcaagaaaacacatgggccaaacttaaagaactcctaatgggcaaagctgaagcaatttaaacagcagaagaaagtagcattagattatgacccaaagtattaaaataaatattcatgagtcaatagtgatagaaataaatgcatggataaattaatacatggaagtagagaaacaaatctcctgtgcagaaaaatcccagataatgtatgcacagccttcatccttgaagaggtagagcatgattctccatctttaagcactgcttttacatggtggctttcttccagagagtacagcatggagaagggaaggaaagggagcaatgttgcaggggcaaaaacctgccaaaaacatcctcagccaacagatcagggtcacgtcagccagcatgtcacattaattgttggtacccttgatcacttaaccccaggagattgaggctgccgtgagctatgattgtaccacagccctccagcctgggcaacagagcgagaacttgtcttaaaaaactattaatatattgggagaaaaatgctattttccctctgtggttttcctccccatacctataattccagtctgattatgaggaaataaacatcagatcaattcaaaattgggggacattctgtaaagtacctgagcagtacatcttacaaccgtcaaggtcttcaaaaataaagaaaaactgtgaaatagctgcagccaagagaagcgtagggagacatagcaagtaaagataccattaccgtggtatcctggatggaatcctggaacaggaaaaggacattaggcgaaaaacaagggaatcattccaagtgcagactttagttaataataaggtgtcaatatcggtttattaatctgacaaatgtccccttccaatcaaagatgttaatactagggaaagtgagtgtggatatgtgggaactctctgtactctctctgcaattttttctgtaaatccaaaagcgttctaaaaatgaaataagtctatgaaaggaaactaaaagccacaggcaatcactcctccagcagcccggtaatggattcccccttccccgtgccctgggccaagactgaactgtgattctgctgtcctgcacccggggacctctatttggagcagtatttggccaagggaagcagcgctcactctccccagtccctcccctcctgccctgcttgcggattttattttagtttgcttccaatggcactcagctgctgctacaggcaaatatctggctgctttgcacgctattgtacaacacactgggggaaaatgagccttcgtgctagagtctgggtccctgagcaaataaacagagaagaaaaatggtgcatgtgggggtggtgaggttgagggagagactggggagccaggtgattgagaagttagtggctaattcagctcagagtttgggcagaaatcctatgcttctccccattcaattttccttattccccggactcctcagaaacacccagcttattggtgggggtaaagagggtattgttttcctgggggtttctgttccaaggataagggagttggaaagagctgttgagggtgtctagccttttttactaggtggaggtcgtctgcacaagcgctctctctcttgcttgctctctctctctctcgctgtctcgctccctcttgctcccgcttgtgctctctctctctctgtcttgcttcctgctttctgagttctctactgagagctggacacagatgcagtggctcatgcctgtaatcccagcactttgggagtcctaggcgggtggatcacttgaggtcaggagttcaagaccagcctggcgaacatcgtgaaacaccctgtctctactaaaattacaaaaattagccgggcgtggtggtgggtgcctgcagtcccaactacttgggaggctgaggtaggagaattgcttgaaccctggaggtggaggtttcagtgagcttgagctgagatcgtgccacttcactccagcctgggcaacagagcaagactccatctcaaaaaagaaaaaaaaaaaaaaagaaattaatggggccagagacctttggaaatttcaatggttgtgtcaaagcaacctgaagtttcggcttcatcaacttccagaaccctttgagagtgtaaaggtgaagaggaggctctgaggctgcctggatgtaccctccaactgtgtggctttgtggaagtcgtttaacctccatgaacctcagcttcctaatgtgcagatccatgaaacactgacacctccttcatgagactgtgtaaaaattaaatgtatcaacccatacaagggacttttaacagtttctggcatcatgtaattttccagtacatgttacccctcctccaaaatcaattatgtatactttaatatgttaagtggtaacatttcacattttaccttctcttcatgtaaggaggtggagagccattgtcaggccttgtctcatcttagaaaaagattagaagttgccagcttcaacataattgtcattgagagggcttaaattttgtttggattaataattcactaattaatcccatagataaagatccagctgaagagtctcattttttcattattaacaatttgaatagatttcatttattgagcaattactatgagccagattctttacagagtgcttaaggtgattatgtctaatcctcccaacagcaggaggtagatactattattcatttcacttaccctaatgtcagagaggttaagtgactttccaagcttgcaaggctagtaagaggtgaagctggagtttggaacagggtttacagagtccagagcttgtctcctgatggatatgctacattgcttctgtttgtgaatttagagaagagtggtttaaaatatcttttatctctctgtttttatggagagaggggagaaagtgctgtttgacgaagatttattgccggagggacatattgagttcgaaacatgaagggtagcaaagctgagattctggcatctgttttcttgcttgtttatcccattgctctgtcggcgcctatagaaggtagctggtttggtttgagttccttccaaaacctggctctaaggaattaatccctaataacaaatgctcagcttgttgttgaaagggtttttgtttgtttgtttgtttgtttgtttgttttgagacggagtctagctctgtcacccaggctggagtgcagtggcacgatctcagctcactgcaacctctgccttccaggctcaagtgattctcctgcctctgcctcctgagtagctgggatgacgggtgtgtaccaccaggcctggctaattgtttgtatttttagtagagacggggtttcaccatattggccaggctggtcttgaactcctgacctcaagtgatcctcctgcctcagcccccaaagtgctgagattacagatgtgagccactgcacctggcctaaaaagggtctttttgactgttggtgatcttcattactcggtgaaggtggagactttcagccacctgataggaggatttgcagtgacttgtcttaggatgggagcacattctcataatgaaagacactcttcccaaaatgttaattcttttggtagccacatgcttgtgttaactattgctttgccactggtgtatggatacaggaaaaagcacttgaaccagaaaacatcagaccaacatgtcctgcaatgctttattcctattgctggatgtttctgcaagtaagtcactctaccaacctttcgagcatctactgtcttccacgaagggatcaggcgtgtatataagccagccttatacttatacttatacacagccgacttactgtgtttgcgacctggcatcatctaagtcaaaaaaactttggtgatattaaaaaaaatgccctcaaaacaacttaatagtatttatagaaattataaagcttcatccagtgcctaaaatgaacattgggatgttagatcattaaattaatgggatgtgatctatgtcctccgtgatttcaaaaacaccattcttttaattgttaattagagaatgtagtgattacagaacgtgaggaacaattttgcttattttcaatatgctggttgtgattatgtgaattattaactctgagcagcattcaatttcgttcatttccatggctttatgaactatttccagtatgcatctgttcttgttttcaattaaaaaaaatatagatttcagcctgtaccttgtaatgaaaataggaagaagcaggaaatgaatttcttatacatcattgtgtaatatttctttatagatttttttttttccaatgtggacctgcctggagacctgtccatgaaagatcatgaggtgccaaaattctcgcaagaaaaacttggactgttattggctatatatttaatactattatacttgcactgcagggaccaaaagtttcttatcaaatttattgagatgattttaacattctgaaacagattgtccacactatatttggaaaaaaaaatgtccaagtgatagatggatttacagcttacacctcaggtttttattatagttgacatttacacagtcttgaaagtctctactcctctgttttatagaaatggcaatgccactcagtctcatccaatattattatggagctgtaacactctggtgaaggatggaccatctattacttgacaaaccctttgtcaagtatatcatgccgtttcagaattatctgaaataatcatcacagaaattcattgacccatcttatgttttgcgaatgtatgctcgaatgttaagaagctattcatttgtttttctcagatgactaaggatggggccatgtgccacagagctccatgtctgcttttacatagttatcattgtgaatggcgccccctacagttgttcagtgtgtagtctgaaattttggagaccctgagtttcttgacattgtttgagccgaagaccgttatctttacttcaggggtggtcctttcacatcttttttattttattttattttattttatttatttttaggcaggtaatttttgcatttgaagagactctgaaatgaccaagctgagccgttgccattaatcctgtttgtctaaaagtttaatcttgagccacccctctcagcaatgcattgccactttctcatacattacaaatatgtaatatgggcaaagtaacgaatgtcatgttatcaggttatgtgtctcaatcactgaaacaggctcaaaaggaatgggacccagtgtcgaggagaagaaaggcacagaggaaagattctgacacttgaagcactgctcagcagggcaaatttggggaaaagatgtagacaagaactttagacaccaggaacaagattgagaaggtgctgagaaaagatcatggctgggccaggcgcggtggctcacacctgtaatcctagcagtttgggaggccgaggcgggtggatcacaaggtcaggagttcgagaccagcctggccaatatggtgacaccccgtgtctactaaaactacaaaaattagcctggtgtggtggctaatgcctgtagttgcagcttctcgggaggctgaggcagaagaatcgcttgaacccaggaggcggaggttgcagtgagccaagatcgcgccactgcattccagcctgggtgacacattgagactctgtctctaaaaaaaaaaaaaaaaatcatggtcaatcattcttaaagctggctaattagtgttacctggagagctttacaaaccccctaccttatctttataccaattgaatcagaatgtctggaatgagggcacaggcgtcagtgtattttaaagatttccccagatatttcttatccacagccaaaattgagaaccactgggctggaggagtgctagggaaggaaaaggaatacaggatcaaaagaacctttcatttgtttattgatccagccgtttttgttttttttcactcattcattcaacaaacacttctcatgaagtccctgtgtgatatacactgttctatgatttgaagatacagctgagaagaaaacaagcaaagccttcatgctcaaggagcttatgttctagtgtcctgaagcaaatcctttctgactcaatagaaatcaggttcacgtggcaattataacacatgacctttcattaaaagcatgacagaatcattttcatgagattgttaatttggaccacaaaacaagtcctgcccaccccacgcccccccaaaaaacaaaattaaattactaaaatttgatgtaatcgatgcatatcacatctatttgtgaaacactgctgtttctaatgcccgtccttcctctaagtactcttcaccttcatttgcctaattcttcaggagtaaacttgtaaccaaaggcaaacatcttacaaatttgatgatacttagacctgcttcccaaatgcttgggaagttttcataaaattgaatgtacataaataatacatggtcaggggttcggagacttaggcaaggtgctaaatttgtccaatatgaggccacctgctcgtatgtcatctgttggcactggctcacgcatttgtgtgccaggacatatgaaattaagtttacctgatgctctctgacagcagctttctgttacaacgtgcaaattagattaggttaaggtagagggcagagtaaatggatggcttcatagactgatactagaatcctgacggctttaaccagaaggtgactggttctggtctagcttgggtcattggtaatcacaagttcctgttattgatgcctgtgcagtggcctgtggggagatggatggcttattttttattgaattttgccgttatagccaaacatcacactggcagtgcaacttcattgaccttcaccctcgaattcgaggaaggaaggtcgaggtgtaaacagaggatggagactaaataaggtagttgtctcttgaatgttgcttggtcccccttctaagtgtgtgatacatgagcaaggctaaaaggttgtacagcctgccacctgggaaccacctcccttgggctgaagctggcatgattacttgggtcttcaaagcaggcgtgcacagtttttctctcaatatgaaatgatctaatgcaaacttgaaattctaccagaagaatcattttttaactttaaaggaatctagagttgtctctgcctcattaagtaactcaattggcttcaaaagcattttttatttatattgaaaatatagaaactgtcaacttcatcctaattttgaagactttttttctataatgtggccttccgttgtgtagtaaacttagtaaagcacctgttgtacaactcaatggcattccatcccaagggatggtttaatggcataaacgaagggccgagggaaaaataaattcagatatttaaacagactaggcaccataccctaaatctttgcttgcaaagttgaccagtgatgcacagaatgaggcagaaatactgtcaaagggactggagactgatctcgagatgttctagcgtggaatggatgggtttacttatttgtttaaataattgcgttctttggaattgcctaaattttgcacttctgccggtttaaatagagtcgaattgaggttgtttctggcaagaatgagtgtcacatttttgaagggaacagcagtgacagcacaacaacagacagttcggagactaaataccattttttaaagtttccgaagattaaatagaaaaacactccggggcttagctaaaaggctaacaggagaaacgaatttcacgtagaaatcaatcgctctgttcactgacacccagtgacagaactaataattgtgtccatgtaaaatcagaccctcttgttactttttaatgaagtctgtctgattctgtgatatttttggcctaggaaatgaaagagatgttttattaaatgaaactaggtctacataggtgaagtatctgaatataactatgtaatcatatcgtacaataaaaagaaaatataaaaaaattggaaagacatgaatgtagttcaaataagcttatccctccaagaaggcttctccgtgttttcaatggaatagtggcctgtattttgcatttgaacaatggcacaaagccattggaaggggaagaaaggtttagcctacccctcttggatccttatgccacaacgtctgttccctgctgtactgagaagtccaactctcctttgcaagccaggaaaaataggacctttttcaaattgcatgcttcgaagatgctggcagaattcaaaagtgctttctccacacagtataaagccctttacctgattaaagctggttatttggcttgccaaggtgaaaagttttcttatgttttatcttgcattttccctctcttcttccctcatttcctctcctcttcctctttctttctttctcatcttccctccaacattaaagacatttggtgcaacctcagcattattatttttaacacccaccttgccaagaagagtataactccaaggaagcttcttttttaagcagacctcatctgttctctgttggtccctgagtggtacctttcagctggccatttttccccagcggtgcatgtgaacacatgtgcgtgtgtgcaggcatgtgtgtacacacactttcatgttgatggagacatatggtcatatagaggatctttgtggtccatctagttctttagtttcaaatgtgatgtgttttatctaatatctgaaagggaaacatctttctgtgtaatttctcaccctgaattacacatttaaaccccacaaatatcagaggacattctaagaaataccttgtgggtggaaaagttgaccttttgtttccctctgcctggttggctgacttgggagagagtaactgaaggcaaagggaatgtcagagtggaggaaattcccatcctagactgggcgaggggcagggggtgtggtccttttacgatattcacccaattcagagcgccctacttctgttcaaaactgtgataagaaatatcaatatgggcatatgacagtatgtgtgggagggtacctccttcacttgtagcatctcacagggagaggtcttggcaaaggcacagtcatcaaaactgatgagcccaaaatgggattcacccttaaaaaaaaggttttgataaaattagctttcctcttaacaatctgggagtgctatcagaatagcagctataaatctgtctggtagggccctctcttcttaaaatagatggatgggtagatgaatggatagatgggtagatggatggatagagggacagatggatggggggataggtggatggatgagtaggtggatgaatggatgggtggatggatgtttggatgggtggatgggtgggtggatggatggatggatggatggatagacggatgagtggatgggtggataggtggatggatgagtagatggatggatggatgggtaggtggatgggtagatgagtgaatggatgggtggatgggtgaatggatgggtgggtggatgggtaggtgtatggataccttggatacatacatgtaatacatttaaattcttaataggtacatcttatgctcttcatgtctctttctctggggaggggcactggggtgctgacatatgctatctttttttgtggttaagaccataaggatgagaccacttcaccaattcttctaggcatgttttgaagcaatgtggtatagtggaaagaacacaggatttgaatcactggaagccagatttaggtctgagcaccatgtgctttttagcttgagtacctttgctcaagatggttaacctcagtatccatgtctgtaaaatggaaaaatgttttctaacttgctggattgttgagagaattaaaagatatctagatctaggcagatagtgtttaactcaatacctagaatagagagagcattttgattaatgggagctacagctactacttcaactgctgctaaggatctttcttgtttttactttcccctccttctctgggtgttttttttttccacgatacattttagaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgctggaagatatatgtcttgatatgtatatctggaaggtatatatcttgtttttcccttgcttttgacagatgttctaaactcaccataccttttggatattgaactataaagacttctacattcctattttatacatttagaattgtgaatattgtaataaaaattcctctgacatttctcacatactacagacatcatgtcccctactttttcttcatggagagatatgagacaatgttgaacaacccagaataagccaaaatataaggaggtaagaatggattcgttgtctgaggctcaatatgacaccacctgaattttctctatatcacccttcaagggggtgaggatggctaagaccactgatacttatgtcatagcatgaacaaataataactacttaccatgtgccaggttcttctgcaggcactttacatagataattttatttaatcttcatagcaaacttagggagtagatgctagtattatcccaagtttacagaggaggcaactgagtcacagtaagctgaaatgacatgctccaggttgcagaatgatcataaagcagagccaaaattaggcaccagtgtcttttggtgtcaggaatctctgcttttgtgcttttctgtctcatgaaaatatcagagtggctctctctattgggtctcattattgcatgccattgtgggttcttctgactgtgtgtcacctttcacaaggagcatttcctacactgtgaaagtgcacatgacaattttatgtacttcttgttgaaatccttgtcttccttatgctgcccattggtgcttcacactattttcttcctcatcccacttccgcagcttgtagctcctgcctgagctttggaagtgaaagccaaagttccacctcgatgcaggtgataaaactagggcaaaatgaataaagtgagagctttgacgtcagcacgtggaacacatacacaggttatgctgaattgtaagctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaaaaaaaaaaaaaaatagggaaaatgatgccaggagcagaaagcaaagatgttttcaaagagtcagaaagactctgttccaaccacaaaccatcctatcttcccccagttaatggggttgcctaaatcgtcaactcctactgtgaaactcaaacccttgttgttccaacttaactttttgcccacagagtagtttaggacaatccaatgtcagtatggcaggtagaagtagcacaaagtaagatccatttgtgtcttgatttgagggacataaatgtcctattttctttacgtgtcttggtcaccccctcacacaggctctctgaagttgtttccgtcattttgtacccttcctcttcttctctttgtaagcttaagtttcacattcattggctgtttttctctctgaggtttcagcttcaagggattatgcatatgagacttgtattatataccctgaatgaaaaatattgaaaatatctcacagctagctggatctctcttaatccaggctttccagaaaaatggtgctgggaccacccctggaagctcagcctgccccaaaccccaggaatcttcagtctgcaagggcagaaccagataatgaaatggcatgctagcaggtagtagttctctgatctaaccactgccacacataaaaaatgctgcagctttgatttgggttttatgtcctgtgattacacggatcgtgctggttcctaatgtagacctttccagttctctgggtgtgcacctctgcatccacatctccttccaattcatggaacctcctttatttcttccctgcctgtaattcttctgctctatgatctgagcttccactcatgcccttattatttagctcttacattcctagaagagtatatgtttatctattttaccactttgggcattgtcatatgtcataggttcattcaccattcattgaacaaatggttatcaattagtcatatgtaccagtccatgtttacacatgacaggcacatcaataggtaagagaggaagagcccatgccctctgtttcaatgttggtagtaacatggcttgtgaaggttaaaagaaaaacccagaagcaacctagtcttgtcatcaaaatgagaaagtaaagatggattgtggtaaagtaacgcagtggaatactacagagcagtgaaaaataaaccaggacgaatctcacaattttagtgttggaaaaaaggaacaataggatgtgttatcctcacttgtgtaaaattgaaaacatgcttgtgtaaaattgaaactatggaaaataatgtgaaacaaattagtatatttcttagggatatatgtatatatacatgtatgtatgtgtgtatatgtatatatgtttgtcagggataactaagggattcctaatctattggtagtatttactaacttgggcataggaagcagatacatcttgtattaagtaatatactgcttatgtgccttaaatatctcattttaattttttataaacaaaattgatatgctcacttcaaattcacctaattttaagggattgaattattccttagatgtattctgctgaacttgctgggtcggatagtgtaaagattgaaaggattgatttaaaaaatggaaaaacattgtgaaggaaaaagaaaggaggcattgtttgagaacgtttgtcttagacatagcatctctacccaacagtgcaaccactcattattcctagcattgagggaagaatggttaattttggtgaaagttctagttcatatgaattcctctctttagtcctaaagttgttgggagtgaagagatctttccatgtcctcgagggctggtaggaaaaatctgtgtcttgttactaccatgttcccccaccatctttcctttataagttttaattaccctccaacctatacctcatgtaaagtttttcactatcacgcattttctacaccttctatgtacgtaaatacacatatatttttaatactcttacctatcttagtgtcagttccagacatgttgcctggttaactttgaatacttcagtgtgttcctaaaaacaaggacctaaccacaatacaattccaaaattaagaaatttaacacactggtatagtcctctggtctcatccacagtttgttttccaatttcatcaattgtcccaataatgaccttgatggcagttttgttcatggtccagaatctaatccatcatgcatttcatttagttgtcaagtctctttagtgtcttttaatccacaacagtgacagtcttgcttggtcttttatgatcttgacatttttttaagaacacatacgctgggccgggtgcggtggcttatgcctgtaatcccagcactttgggaggccgaggcaggcggatcatgagatcaggagatcgagaccgtcctggctaatgcggtgaaaacctgtctctactaaaaatacaaaaaattagctgggcggggtggcgggcggctgtagtcccagctactggggaggctgaggcaggagaatagtgtgaactcaggaggcggagcttgcagtgagccgagatcatgccactgcactctagcctgggcgacagatagagactccgtctcaaaagaaaaaaaaaaaaaaaaaaaaaaaaaaaaagaacacaccctggactgcccattgccgaatcacctgaagagagcccttcaattttaactaatcatttttgcaagcttagttgtttcagctgctacaaaaaagcacgagtcttttaaaaaggagtaaaattctgacacgtgctacaacatggacaaaccttgaaacattacgctaagtgaaagaaaccagtcgcaaaaggacaaatattgtatgattctacttatttcaggtacctaggatagtcaaattcatagagacaaagtaatatagtggttcctagggaccagggggaggatagaatggggagttgatgtttaacgggtatagaatttcagttttggaagttgagaaggttttagaatactgataatagttgcacaagaatgcaaatgttcttaatgccacttaattgaatactttaaaataattaaattggtaagttttatgtaatgtatattttgctacaattttttacaagagagtgggtcctcaatatgtaaatataatgtcaattaaaataacaagaaaacacaaggcagttatttactttgtggatgaccctcaatttgggtctttcagctgtttctttatgatcccagttggggtgtgcatttttgccagggatacccccaagtaataatgtcctgtttttcccagggtgccatattaagagacacatgatattagtttgtctattattggtgatattaacatcagtcctttggatcatatgatgtctctcagatatctccagtaaaaactttctcactgtaattaatacatagtttgggggtgggaggaatggttttagacttttaaaataccgatttgtcatcaatccttcattcactagttttaccattcattgatgattcttgtctgagtcaattatgattattacggctatcaaatgatggttttctaaccccattgcacttatatgtgtgggttggcattctatttcctttcctatatatatacatttaattacttatttcagtataaagtcatggattcgtgtttttattctatgaactacaatcggttactttcgttatttgttttgatgctcaagttgtatcatatgtattcactgggagccccttcaagctggctcctgtatcattttgacataaacccgtaagttttttttaataacatccttattccttggcaccagaagatattccaggtatatcttgacttttcttgccccagtcctagagccaggaggccatttttccacagagtaatccttcctttgattggagagtggtgtttagaaacaaagttctgggcgattatggcttctggaccctctaaatagacaatatagatagaactaggaaaaaatacacacatgcacatacacatgtatatataattatcttttcaaagccaagaatttgttaatccttcctaaggattatgttcttcccaacaggatacattatctaggttaaaatttccctgcctatctgatatcacttgttattacgagttatcttttatctgtctgttaggctgtgagacccttcagaagagagacttcatattttttgtcatctttgtatccccattgcctaggaagatgtctggtacagattaggtactaatattaattcataggattgttgggtgaaacgatggttgaatgaaaggatggttggttaggatcattgggtaggagggtggatgggtggagtggagattcgatggaaaagtatagttgggtgggaggatagttctttgggatcctgggtaggagggttgttgggtagaatggagattgggtggaagtatactcggatgagagggtggttggtaaggatctttgggtaggagtattgttgggtggaatagagattgggtggaagtatactcggatggaaggatagttggttaggatctttgggtaggaggatggttgggtggagtggagacttggtggaagtatagtcggatggaaggatggttggttaggatctttgggtaggaggatggttgggtggaatggagaattggtggaagagtatagttggatggaaggatagttggttaggatctttgggtaggagtattgttggatggaatggagattgggtggaagtatagttggatggaaggatagctggttaggatctttgggtaggaggatggttgggtggaatggagattgggtggaagagtagagttggatggaaggatagttcattgggatcactgggcaggagttttgttgggtggaaaggagaatgggtggaagtatagttggatggaaggatagttggtgaggatctttggataggaggatagttgggtggaatggagattgggtggaagtatagttggatggaaggacagttggttaggattgttgggtaggagtattgttgggtggaatggagattgggtggaagtataactggatgggaggatggttggttaggatctttgggtaggagtacggtcgggtggaatggagatttgatggaagagtatagttggatggaagcgtagttggttaggattgttgggtaggaggattgttgtgtagaatggagattgggtggaagtatagtcggatgggagggtggttggtaaggatctttgggtaggaggatggttgggtggaatggagattcagtggcagagtatagttggatggaaggatagttcattgtgatcactgggtaggagtattgttgggtggaatggagattgggtggaagtataactgtatgggaggattgttgtttaggatctttgggtaggaggatgtttgggtggagtggagattcagcggaagtgtatagttggatagaaggatagttcgttgggatcactgggtaggaggatagtgtagaatgaagattgggtggaagtattgtcggatgggaggatggttggtaaggatctttgtgtaggaggatggttgggtggaatggagattcggcggaagagtatagttggatggaaggatagttttttaggatcactgggtaggagcattgttgggtgcaatggagattgggtggaagtataactggatgggaggatggttggttaggatctttgggtaggaggatggttggtggaatggagattcagtggaaatgtatagttggatacaaggatagttcattgggatcacagggtacgaggattgttgtgtagaatggagattgggtggaagtatagtcggatgagaggatggttggcaaaatctttgagtaggaggatgattgggtggaatggagattgggtagatatacagttggatggaagaatggttttcatgcaagagcatttgggttaggggatggttggatgagaggagttgttaagtggaagaattgtgacgataaaggatcattatgtgggaagacggttgtgtgggatgtggtctgcatgtcttatttagcaatgtatgtcttttttgttatacttctgtactcattgcattcaggtgctgtttaagaagttattttggttcctttttgtctttcagatagtaggtgttcattcagtatctattgactgtgtgactatgactttcaggaacaggaatggatgatttatctttcgattctttgcattctccatagtgctcagcttggcgtaaatacagatttaatattcagtttgacagtaagtcagttagaaaaccacagcaacataatatctgccctatttaccttttaaagaaaactaaggatgctgtattagtttcttcaacactgagtgtggacttgattcattgtctctggatattcagttgccccaaaattattcaagtagtctacttggcaagtatttcaagaatggagggcattgtttagccttgtaattattcattggctcatgtaattaggagacaaacttttgctttggaataagggttacaccacacaatttgggatcattttgtgatcaggcaattgaataggctagaaagaattcctttactgatggatagacattctgaatacctgttttatccttttctattttctcatactaagaaagtaagtagcaaattcttctcacactgatattgtgaacagaaaggaactctactatttttggccatatatatgtttttttaattttggatctattatgtgttctagtgtctttagagaaaattttcgtaattgaaccttagaagagaagacaaatgctgtgtaatgtacataagaacaagaagacgttactctagctgaaaatgtcttttttccacagtactttatatcctggccaactgctcttgtgcaaggcgaccaagtaacattttcccattcagctataagaacgaagagactgttattgccactggctggtattgagtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgcaagagggtattttctgtgaacttcatgggtggctttcatagggaattctccatgtcattctctgatgtcttttattggcccttgttttgccagagtggggaaaaaaaacaaaaacaaaaacaaaaaccaccttccctgtgtcatttctcttttaacaaagaaagccaaaataattctataaatgaaagtcatgcacatgtagaactttgggtgcagctctagagtattttttttttttaaccctcctaggatgaagccaaaagaagaaaactggttgtatttctctaacatttttaggcagatgatcgtttctgggcagggggaaaatgccaaagcctgtgcagtttctctttcggctcatttgaaaatactctaggaaaagacccctgtggattctctgccccttctgtaatgtgtggaatcatgtgattgctggacagcccccttggaagcctgccagcccagcctcttcagcatccagatgggaacccggaggcgcatctcacagcggaccgttgattaacccaaggtcacctggctctggtttctgacggagcgagaatgagtacccagaggtttccagaacctcagcacaaagggtatccatgatgaacaggcatttccctatcccttctctctcctgtcccctgcataaacaatgcaaaaaacacactcccttcttggccaggacccaaagacctattatcctacacatgtctttctgtgctttgagggatcagcaggggtgccagtgaacttggattactctttggatcaccctgctgcctccagctccccctctgttttgtttcatgactcagtcatcctgtttgagctcatttaccacttgtataggggtacattccttgacttctcagagcaaaccaagcccccatccatgatttcttcttcttttacaatgagctctcatatcacatttatcccagtggaaatttcatatcaatatctgtgattctttgactgttctctctttcccctagactccaggatccttgggatcactggccttgtcatttatgttcctgcttatgtcctatagcctggcacttagtgaggcggtgtgttgtgttgggttttgtttgtttgttggttggttgttgttgttgttgtttgcaagggcccctgcaaagtatcacaaactaggtggcttaaaaaagcagacatccattctcttgctgttctggagcccaggaggctgaaatcaaggtgttagcagggacatgatccctctgaaggcattaagggtgaatccttcgttgccttttccagtttctggtagttgctggcattccctggcattctgcggcttgcagctgcgtttttgaaagctgcctcactcctaacctctgtttacattggtgtctgttcacgtcacctgtcctctatgtgtgtatctctgtgtccagattttcttccgtttgtgaaaccagcagtccttggtttagggcccaactaatggtttcatgactcctgtgttagcttcctagattgcagtaagaagtatcagaagctcagtggcctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaattccatccctacaaaaaaaaattaaaaattagctgagcacggtggcctgtgcctgtaggcccagctacttggaggctgaggttagaggatcacttaagcccaggaagtggaggttgcagtgagccaaggtcatgcaactgcactccatcctgagtgacagagtgagaccctgtctcaaaaaaaaaaaaaaaaagaaaaagaaaaaaaaaggtatcagtccctgtatttaggcctcatcttaattccatatgaactcatcttaattacatctataaagaccctatttccaaataagcccacgttctgacattctggggggccatggatttctgggggttgttatccaacccagtgtacaaggcagtacacatttattgaatgcatgaatgaatgataatgctctgggccctggcaagtctcagcctggagaactgagtctgcctgcctgcgtagaatcaagaacaacatgcacttcagtggaatttgggaagggtcagggtctgtgccgacagaaatggaaaaatcctccaagcgcctcaccctctcttaaaagactcctcaagattgctttgctgttctaccctctacagtgtttttaatatgtctatttaaatgcaaattttgactttctgtctgtaatcatataaaatgtttggcactaaaattttaatcaggaatgtaattttagatagaggcggtaatggagtggtaggccacacataacagaatgaagcttccccaacgtggattcccagactatggaagtgctggcctccctgctcccagctgagccgggaaaactctgccccactccaagaggtgcttctcaaagatgattcctgatcccaggcatgtcctgtgtcctgtcaccaatcctggtgcttcatcgtcctttaaaatccaaacgaggtgatctagtgttcttcctctgcgtcctctggtcttctagcatcctggataggccgtgtatgtttagaaagaggggctccaccctgtgcccgcctaagatgatggctcatttatcaagaccaggctggaggctcagctaccagagcttctgttgtttgggaggaaggctgccagcagcagatgtttgtcctcgcctcagctccctgcagcctttgagctccatctgccgcacactcgggcacagctgccagtgcttcccctccgtgctcacctttcacctctcacggaggctggggtttcatgcatctgggcccaacagagagatggtgacccagaccctgcgatcctggtgccacaatccttcccaacagctcgctgggcatctttctgcactagcctgtcagcatgctggaagcagcaccgatggaggttgttgagcagggttgcaattgtagcccgtcactttggtcttggtgttccatcttgttagggcaagagagtcagagcacacacagccatctcctggctggatcatctggtggagtgggagtgtgcacatgcccacccccatttctaaataagatatgcattgtctcagggcctttgcaatgtccactccctagtcctcaatgctcttccccattggtcatcccagagctcatctcaaatgtcaccctttagaggggcagctgtcagtcttcccagttaaagcatatgccaaccccctcatcactcctggtctcaacaacctctttatttccctcattgctattatcttcatctgtaattctcatctttataatatctcttgaatgaatctttaggaggattactcttcctagagtgtgcaaaacggattgcagggatggtgagaggtgggcggaaatgttggaaaggggacaagggtggaattggtagcactgatcttgttgagagaggattggccctggaaaaagaaagtagcaatggagcaggaagtaattagacatagaagagagctcttcacgtgggaggtgaggagaatcggtgttgggattgtgtgttaggactgaggaaggaggaggaggaggatgcccagctttctaaactgggtatttgagtggatgggggtgacttgccgaaaataaagaatggtttgagaagaaagatgctgtgctcatcttggaaatgttgagttttgggcccctgtagaagacccagctgagatttgcaggtctgcatcaaatggagaattcatcagagaggcaatggtactcaaaaccatgacagtgaaaggtgcttccctaggagagaggcaggataaaaaaataaggtggcccaaaattaggatggccacacatcccagttagccaggatattcctgccttatacctgttgttccaccataatttctaatggcccccgcccccctactttcactttcacttgtctcagtgaactatatcgtcaccctacccgcatgagaaggttggggaaattcagagttcataggagggcataagaacccactgaaaaaaactgagtatgagcagaagggtagaaagaaaaaccggggtagtgttgggtaatgtatgccaagggtagaaaattgacaagagaagaatcattcatgtcaaatgggtcacagaggtgaagtcatgcaagtgtcaagagctgtgcattggatttagctaccaaaaaaaaaaaaaaaaagtcttgatgaccctgtaatcatgatggtgggaatatgccagagacaggtggctttgaggagaaaatcattgatgagaaactagagacagtcagttccactaagttttgttgtgcaagaagggggatatgttagaggagtttgcagacgggcatgagagaacaagagaaggttcatgggatgggaggcatttgagcatgcgtcagtcctggaaaggggcctgatggagaaagcttcaggagagggggtgtccacatgatacagcagtgttcccaagggagagagagcagatgcaggaagggacaccttccctgttaacaggcaagaaagagcaagttggggtgtaaggaagtccgtaggctttatggcggggatttgaagagagtagcatttattttctcctctgaggtaggaggcatctgagaggtgggggaggttgaagatgggaggaaagtagacagttgctttaaatagccacatggaaaatgggagaaggaattggctcattcagatgacttttattgggtgccttctgtgctccaagccctgggaatcaactagtgaagaaaacaatccaatgggactgatgttctccttggaaagagaacagtgacggtggtggaggcagcaaagggaacactggaggctgaagacccctccccaacttataatgatgcgtctgtgagtggtgaatggtggggattttttttttttttttttttttttttttttttttttttttttttttttagtagaactcagcagcttgggtctagacacagagaaaatggacaacttatggtctagagatggcagcacagaaaggaaggtgagttgaagttctggggggaaaataaatggcaggtaaagttatggaccatttgatcaaatcctggtgtgaaataaagagcatacttaggatatgtcttttgttttttcttcttttcctctgacatgcattgctatcatgagtgtccttgaacaaatctctttgggggcatacaaaaccatttctgtaaaacaggtgttaagtataggaactctgggtccaaaggagaacacataatcaatttggataaatattgccaaattgtctgttgcacattcctcaccagtttgtgctgccttcagcagtgcccaaagcgcctccttcccttcacataccgttgccaacataggccattatctttctgagttttaccaagtggaggaacaaaccaaaggtcctcatatttttctgtgcattctggtgattgcttgtcttggcgagcatcttctttttaaaataatcttgctgggggacttgtggtatgcaatgatgactgtggaagtattttagggggcaggtcagagaggagatgcctgtcagtttggggcaaggggatttgggaagtttttggaggaaatcaaatgggagacaaaagaatttgtctgagagctggagaagaaggaatagatcctagagacattttcatttttgttgcattttatttttatagatttaagatgtgtaagtacaaatttctcatgtgcatatattgcgtagtgatgaggtctaagcatttagtgtacccatcactggaatagtaaacattgtacccaaaaggtaatttttcaaccctcacctccctcccacccttccatcttttgcgatctccagtgtctattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtggcacagatgagtttgcttctgtcatgacgctggggacatggggtcctgtgtgctaggccaggcattgggccgatgtatgcctggggctaccgcatctgctgctgctggaactgggtctgccctgtgtccctcgggattccagcaagtggacttcatcgcattatcatgcattcacctggtcagtttctgcacgggctgtttatagggcacgggtttaatagctgtctcccctgctgcactgcagattccacgagggcagagaccatgtccggctggtcgatcatcctctcctaggaaaaggctctgcaaagttttcctgtaaagggccacacaggaaatatttcaggccttttgggctgtgccatctctgttgctattcaactgcctttgtagcgtgaaagctgccttgatgatatgtaaacagatgggtgtggctgtgttccaataatactttatttatggatgcagaaatttgaatttcccatcattttcatgtgttgaagaatagtattcttgtgatcctttttccccaaccatttaaaattgcaagagccattttagcctgtgagccatacaaagacaggcagtgggcctgcggtctgaaagcatagtttgttggtcccgtcctaaagtttagcacagggcctgtaatggcagtaaacactcatttcatattgtggaagaaaagaaagaaggtgtgtaagttgtgtttttgtgcttgctttctcctgcagagtgggtaaaggaatggtactgaggactagtaaaatgcaaagatttggtatcggtaggtcttcatcctgctcctaatgcatagtgtgacctggagccagtttgtgcagctctttgggcctcagctgtcctatctgtgtgatgaggagaagcctagcttcattaagggatgtgaaaatgcttttaagactgggtgcagtggctcatgcctgtaatcccagaactttgggaggctgaggcgggcagatcatctgaggttaggagttctagagcagcctggtcaacctggtgaaaccccatctttactaaaaatacaaaaatcagccagatgtggtggcaggtgcctgtaatcccagctacttgggaggctgaggcaggagaattccttgaactcaggaggtggaggttgcagtgagccgagatcatgtcgctgcactccagcctgggcaacagagtgagactctgtctcaaaaaagaaaatgcttttactctcaagcccactgaaaagtgttaagttattacccaaagcaggagaagcagcacaatagaccaggaagctctaaatcctgacaagccagtatttacgctgcagccagcccagggctcagctgcagaggcagcgaaatcctaacagtgagcaggaggatttgacatctggtgcccaagaagtttgttaaggttgcccagtcacttgctgacatgtgctagcaaattctcatgctttctccaaaaaaagggtatactatgggcttcgctcccacaacattttggtaaatcttccaagaagatctggctttcttcttgttaaaggaagcatttgatggcagcctggatgaaatagatatcaaatctgagtgacattattgctgttgttaaactaaagctgaacctcttaaacttggcatcagttgactctcctctttgtcagaaaacctatgcaggatgccatgtgatctggaggacacaaaagcatgattgtgtcatttctttctgtatggagtctgtgcagtcagacagttcttttctatcttgctttcttccttgggtcaggacaagtccaattcactgaatgcaccaagccccttctagaaaaacagcacagggctggacacagtggctcatgcctgtaatgccagtattttgggaggctgaggtgggcggatcacaaggtcaggagttcgagactggcctggccaacatggtgaaaccccgtgtctactgaaaatacaaaaattagccgcgtatggtgtgtgcctataatcctacctactcgggaggctgaggcaggagaattgcatgaacccgggagacagaggttgcagtgagccaacatcgcaccactgcactccagcctgggcgacagtgcgagaatttatcttggaaaaaaaaaaagaaaagaaaaacagcacaacaaacaagaagagttcagtggttacaatcaaattttaaaccaattgtcaaagtacaagccaccactaagcagatggtgggatctggtttttgttttgttttttgaagcataatggatcctctgtggtatgggaattttaaggggaaaaaaaagagaacaatttctccttctctgcagtacatttactgctgctatcactctctttctaccctgaaatgtttctgtttcaccaccattcatctctcttgattggttttgcttttttttttttttttttcttctaagatgttgctaaatttgcttgtaaagttttgtttattcattggcgcttggttgaaaggtgctggatcattaatctaagtattcaaggttaaccatgctttatgctgaaattgcctttttatggaacagatttcaaggttttgcaagagttgagtgctacctcatttttgacatttcagcaatgaatcctgtttgaaatgtgatttgaatccaatcatcatcttatttgtggaggaagataaaaataatatacaaatattgcagtaaaattgcatttttccctgccccctgttttgcatttcaattcagctagattctgctagggtggcacccagcaatggcatccctgctttaattctatctttcattttttttccctcccagaaggcttaaacatatttcctttctatctaacataagttgtacagggcttctgaagagtgtgcattgaagaaatggagcttacacaattacttctataccttattatggaatctgagggtaaacagggctttggaggtcatctaattcgtctccttttgcaattacagaattatttctttgaaggaacaaatgaagaatctcttcttccaggcctctttgtaaatgtgtgaacaagtttataagtgcctccatctcagagtgtgtgtggatgtggctttttaattaaagaccaaggcttcaagctttgctgttttctccgatctgatatagccactgttcctagtcacatcatggagctcttggtcagcctgtgatctgggaggtttcttttctaactaacgtgtatccttcccttagaactagtctgcaggggctggtaccaggcagcctctcttaagaaacttacacccagaaactgctccatttctgtgtaaatggtagccatgtccgagtgggtgtcactcaccctatttcagcagcaccccctccctgtttgctatctacaaattatctctcccctcattaaagtttggtcttccaaagcttttcaaactctcagactctcattcactctaaaatatttacagattaaccatgttcagcctcagcatggtgtcatcatgggaagatgctctcagtgtggacaagataaagctgttaaagctggttgagccaagctttttcgtatttaaataatggaaacaggaacaggcagtatgcatagttaaggacgtaggtctgggttcgaactctgcctttgctacgtcccagctgtgcccatgacattatttaacctctcttgcctcagttttccccatctttatttttgttttattttattttattttttgagacagagtctccctcttttgcccaggctggagtgcagtgccgccatcttggctcactgcaatctcctcctcccaggatcaagtgattctcctgcctctgcctccccagtagctgggattacaggcatgcaccaccacacccggataatttttgtatttttagcagagacagggttttaccatgttggccaggctggtctcaaactcctgaccttaagtgatccacctgcctcggcctcccgatgtgctgggattacagcaagtttttcccatctttaaaatggacacaataacaaacctactttctaacactattgggagaacagaacaaggtaatgaacagaaagtgataagcacagtgactcatgcgtcacgtctacacatcgtatttagcaaaaagctaagcaagttattcccttgctgtgaattatcagattctagtaccagggagctgaaatactagtctgggggaagagtgtgccaatgagatctttgtatgggacagcttccccaacattagtgtgggaattccattaagaactcatttcttttttttctttcttttttttttttttgagatggagtcttgctctgtcgcccaggctggagtgcagtggcgcgatctcggctcactgcaagctccgcctcccgggttcacaccattctcctgcctcagcctccccagtaggtgggactacaggcgcccgccaccgcgcccggctaactttttgtatttttagtagagacggggtttcaccgtgtcactcaggatggtctcgatgtcctggcctcgtgatccgcccgtctcggcctcccaaagtgctcggattacaggcgtaagaacacatttctaagcttcacactgctgtcctgttgtcatgatgataggtcaaacttactgcagcttagtttgggcgggacattttggctgggaacaccaatacccgtaaaggtcatgtttacattcttgtgtgagcctttctttaaccactgagtgtattttctatcatgattatcatccacttcttgctgtgtattggcatgagggagtctttgtcctcctccatttgttcatccaaaaattactgaatagctaattaaccccgatgctggggatacaccaaacatgattcctgcaccttttcgagcttatatttggtggaaaggatagaaaaagcagcaacaaccaataaatggaaaaataaataaagccatcacaggtggtaagatgtctgtaaaagaaaccattgcgtcccaaagagagaaaagaagttcttttagtatctccagttgttaaaatagtgtctgacacatagtaggaactcaagtgattattcactgagtaaatgtttacggtaaatggaatagtttaggtaggggaatccacaaagattctctggggatctactatttcagcagaaatataaagaattattcatgagatgatcaaggggccagatagggctgggaggaagggaagtatgggtggtgagaaaggcggagagctggaaagatattggattgtttgaggaattgtggaataaagaatctctatggttgaaaaataaagagagaggtgttggggtagttattgattccgcaaagatgaagctcagagagtacccaggaacatgactggggtcataggttctggagaggaacttggactttaattgaaatgcaaggggaaatgactaaagtcttggtaaagtcaaagtccattggcaaccattcaatgaacttcaaatccatgccttttagggttggtgaccctgaaggatgaagcgttggccttgagaataaggcagttcttgtaagttcaaccactggctttcacttacagccttcatcacatcactcacctcctgtaagcatccgtagccttcattttcaatggagaaaaaagaagttgagatgcatttctccccattgctattttggaatccactcagagcactcagcgcctgctgttgttctcattggaatcttgctgtcccatgcaacttgacttctatttacactcctcggattcgtatgtgcaagtcttgcttgtgagggaagagccaccctagatatgaaaggacttgattaggaaaaaaaaaaaaaaaccttttgaagagagaggtgtaaaaaaaatgaagccattagcgtcaacttaaattcaagatatttgggatgatacatctgcttataggctcataaaacaggcaccagctcaaggttatgtgaaacaaagaaaatgtctagcattgctcagctgttttaggctacctaattatatttttagctttatgcacttgggattctcttttcttttttatttgttttgagggtgtatagtgggcacctgtcaattctgcagcccagaatccatgcccctacttctctaagagtgtccatttttccctctggtgatcattcctccccattctcagaccttttgacttccaggagagcttcgtctgtctcagtctacagggaacaagtgtgtggcttccacctggctctgagaagcactgtgtaccccagtcactatgactgttgaaaggtgagcatgcgcacctatcagaaccagtgacatgaagtttgtggaacattttttttttttttttttttttttggagacagagtcttgcttttggccaggctggagtgcactggaacgatttgagctcactgcaacctctgcctctcgggttcaagcgattcttctgcctcagcctcccgagtagctgggactacaggtgcatgctaattttttgtatttttagtagagatggagtttcaccttgttaaccaggatggtcttgaactcctgaccttgtgatccaccaacctcggcctcccaaagttctgggattacaggtgtgagccaccgtgcttggtcctgtctgtggaatttttaaaatgtgtttgaacttgggggacgtaggtctgaagctgtttgcagccattttggcaccatgtggagcgtaggaatgaaactcacactcacagaaagtgtgaagaagagcagaaagaaagaaatgaagaccaaggttcaatggcaccatttaatggtgatttaaaacatgtgtttgtttttatttttacttattatttattatttttaattaatttgtcttttagttgacaaataaaaattgtgtatatttgtcgtgtgatatatatatatataatggaatactactcagccttaaaaagaaggaaacctggctgggcacagtggttcccaccagtaacctcagcactttggtaggctgaggtgggagaattgcttgaacctaggagtttgaggctgcagggagctatgattgtgtcactgccttctagcttggatgacagagcgagatgctgtttcaaaaacaaaaacaaacaaaaaggaaattccatcacttgtggcaatatggaagaacctggaggacattcggctaaataaactaagccaggcacaaacatacaaatacaccatctcagtaatatgtggaatctaaaaaaagttgaactcacagaagcagagagtagaatggcggtttccaggggctgacaggtggagatggagagttcaggagatgttggacaatgacatcacttgaaaggtccctggatccagctaagccttaacccttttatccctctaactactgagttacctaaactagtaaattccctttttttagtcttttcacccagcttggctttgcacttttgccagctgcaaccagcaaagttcacactgtggcaggggtgctcatcagtacgttcagttcatgaggaggactcagatgatgcatgctgcagggattcagagggagaatttcttttctccttcatagagcccatttttctgtgtctgtgggcacaagttgggaaaggagagaataatgaaacgacatgcacagatgcatacaggactctgcagagatggtgcaggcattgtcaagatgacctgcccaccactagcttacatatccttcatttttttgtgtgtgtttctttcaacactcttcgatcatgaaactacatcttttattttccttgacagtgctcaagaaaatgtggtcattaagtttatcatcatgaaagcaggcacctggtttctgaaatactagacttcttcatgtgtatcatctctgtggtttttcagaactctaaaatgaaggtccacttagtccaattgctgttctaggaacctgtgatcttttaatcttggatgtctctacctaaactatggtgtgagggtggtgtactaacaagcaactgaagttgaatgacaagagtaaacatgaggtaggtttttctcagtgctaatcaatgacgaacctcgtgctcaaaaattcagctcaggctgtagccaccaaataaatcatgggccagagaggttcagggactcaaagacatgaggctgtacccaggagaaatcaagctatggactggtaaggctcagaataaaaattgatgctgtcttcccagtatttgggataataggattgtacctctttgagctacttatgtgtactgccatctgagtcgctgtctcagcatttccagcagaaatgcaacagggctggtgaagtgtccaggagtgaatgacttgtaagccattaggaaggccggggaaactgtgtttgggctaaattgcttttggtcaggagctccatcttctcatggctgtgaaatgacggatacctgagagaagtcccagctgaaagccgtgtctgcactgttgttttctaagtggatgctaatccgttaattagaaggtttgcagttatccttggcactgtatgcgtgcatacattagtatttctatttatgcacatgcaatggatgtatttacatatccgtaaacctgagtctttttacctacctcttagaggtgccattctgattattttctggtttagagatggaaagacaaaatctgcccctccccacccccaaatcctgaacttgagtggagctgtggtgataatactgaactgaagggctgtgcaggtacctagtgttttactttgtgccaattatttgttaatgcaggtatcaattttttaaaaaatgttttggatgacttcagtgtgccgggcactgtgtttgtttctgggaataaaatagagaacaaaaaacagagaaggtgtcagcccttttgcaacttataatttagggagggagtgagaaaaaaaaaagcatggaagaaacatatcagatagttatgatttaaattaaataaaataaactatgaattaaaattagttgatgcgacagtatatggctaggtgagtctctaagcttaggttataaatgatgacttttacaaagagactacccttaagttgaaatctgtattataagtagggagcacctataaatatcggggcagggggttagttttgagcaggtggatcaattagtgcaaaggtcctggggcaggaaggaggctggagtggtttgggaaccaagaaagagccgggccagggttgcattttagtggatgatagggaaggcagcatggaatgaagtggagacgggcttgtggggccgggtttctcaacctcagcactactgacattcgaagctggagaatgctctttggtgagggctgtcctgtgtatagtaagatgttcagcagcctctctggcctctacccactagacgatagtacctcgcactcctccagttgtgacaataaaaatgtctccagacatttgccaaatgtcccctccaaatgtgacaaaatctcccttggttgaaaaaccactgaaattggccttgcctgcaagaagtttgagtttattctaggatccatggaaagccactgaaagtttgaaccaattaagtatcacgatttgggccaggcacggtggctcacgcctgtaatcccagcactttgggaggcccaggcgggccgatcacgaggtcaggagatccagaccatcctggctaacacggtgaaaccccgtctctactaaaaatacaaaaaaattagccaggcatggcggcgggcacctgtagtcccagctactggggaggctgaggcaggagaatgacgtgaacccgggaggtggagcttgcagtgagccgagatcgcaccactgcactccagcctgggcaacagaacaagactccgtctcaaaaaaaaaaaaaaagaaaaaaaagtatcatgatttgattcacatttttaaagatcattctatttgctgtaagcaaatgggttgcaggaaggcaatgtggaaaggaaaaaagttcatggtcccagagagaggttataattgccttgatggaaggtgatagtcatgggaagaaagttctgtaggcagatatgatttggataaagttgacagaatttatttgtggaccagatggatgggcagggagagaaggagaagattaagtacaattcttagatttttaaataacaaataggatacccctcccatcctcgaagagctcacactgaagtaagggaaaacaaacatatatattgcactcattacagtgtgctctaataaatgcatgaacaaaatgtttcggcagcgctgaggagagagtgaataagtctttcagagaaagtcagggaagattgctcagaggctgtaaaagcttttgaagaataagtaggatttttctaagtggagaaggagctcaggttcctggtctatactaagaggaaaccgtaggagataatccctcttcaataattcaaactgctgtcaaggaaaattatgcccagagtgactctgttctatggcctgggagggaaactggggtgaatgtcctaaattgttgtctttgaaaagaccgtttctaaaattcgtggcccaacgtagccttttactggttaactctaagtatttaagatgttctccaagcgttttaactgaagacactgcgtcttattttgtcttcattgaatttcgaagaagcatctgtagtaagaatatttacacggtttttctaggtaattgtttgtctcctggaccatagagtaccttaaatacgttacattatataatttactaatagtaatacaattttatgaagatatctagaggtaacaaattcaagattatgtatttctatctctggaataataattactgttttcatttgtaaaagagattgtaagggaaataaaatgtaaagttaaagctaaatgtcattgtattctatgcttgctgtaaggtcaaaatatgtgatcctgatggaatatggtaatatccctttgctctcctccgcacactgaggaaccttttcctgggactaatagacccccctaatgggatgcagacagtgcctcagagtagatgttgttccataaatatctgggggcactccagattgggaccttgagaactagatggtatgctaaattccctccttcctttgcaggaattaaaaagcatccctcaaattgacaagaaaattggataataaattaaccatttacagtttggtaaatatatgcacaactgaagttccacgtcatgggccatatttttatcagacgcaacaccagatgaaggataaaccatatgacccaccctcttctgccatgaatgaacaatggactgaagtctttcataattgcttgtttcaagatgctcactaaatcagacaaggaactcctgtcttgtgtctttaagggaggttgaacaataggctgggacactggagtaaatggggcactctgccatacttacactttcctttgaaatttgtgtttgggaggctttaactatgagtatattttgcagccaaatgcagttagctttttgactaatggagctggtgtgaattttacccctccatctgtagatgctgaaatgtcacattatttcatttttctaaaacaaattaaatgactctgagcatccagtcattagggttttaagaaactcaatcacaactatgagtatagggaatggggatgaacagtatccctttcccatatgctagatagacagtcacctgtggagcttagcagtgcttcggatacagggaaggacagctggtctttgagatattgtgggcatttgggtgttaggattcttattacttaaacctgcccagtccctataaaaagggaccgctttgcaaattctgatccatgcatggaacaggaaatctttcttaatatttagctgcttcatgcattcaaatccttgaagaccccccacatgccctgcacccttctcagttccctttcaatcttggggtatctcccctttctgagaattcactgctgttgctgacctcctcccactcatttccttccatcttctcttactttcttaataccccacattatctctgctgactgtgtctttagacacacaacacttttctttaaggaaaggcaaggctgtgtgttccttacctcatcatgttatgttagaggtccaaatgttttatgggtgaccaattaattcatcatgtcatctggatgactgttgaaagcaaaagcgggatcattgtaagaactgtgtcaggaaaccagcaaaaccagccctgtcccaggcaaactgggaattatgatctctctctggaaggaaagaagaagaaaagtgggagaggtaggctgttctttttccaacaagaatcttggaaggcgttttcattttggaaactgtttagaagactatactaaattgttactccttattaccaacatgcatagcatcctgcaatgcagacatccatgactgtgcatctccactgcttcaaacagggcactagtgttccaagctttgtgtttctattgccagccctgaatgcaaaaatatgggatcctgagttcaaatcgggctcagaagttgacatattgtttgaccttgagcaatctgcttaatttcatagtgtttgtttgctcatctgaaaacaaaagggataatgctgatcgaggcatattgtggagattaattagtttctgaagtgctgagatccacagatgaaaggctttaagtggaaattattttgtttttaaaggaataatcgatgcatgtgaataaaagagaactaactgaactgaattacaggcacttggctgctggtgggagtgggggaagaaagaatattgcttcttgcaaagaaccttaaatttaccccccagaatagcagtgggaaaattgctttttttttgtgattctgaaaggatgagaaattatgcaaaagaaacgagctagaataagaggagaatatatgcagttaagacatatttcaaagtaactttcctggataaacaactaggtatctaatatatatattatgtgtattagatatatatatgatatatatgatatattaatgtattagataatgtgtgtgtgtgtaagtatgtatatactccaccagtcctctgtgattaggttcttagccaaatgcttgtctaccaaaacagctcagccacgatccccaaggagccttaatgacccctaagtccttggtgaaaagatcagtttgggaaggagaaactaactgtttaaaaatctcacagctgtgtatcgtggtgagaaaactagcactattaagcgtgttactgtttaaaaccacttttgctcttgttacatttggtcttctctccaataaatattattattgcccttgatgtacagataggaaaatgataatcagggaaattaaatggctggccaatggccatttgtttggttaggtggtataggcaatattctgacctcaacattatgactcacaagactctgaccatgtcactgtcaccgaagggtttgctaaagatatggtgacattcagctggcatgtggaaatgaattattgtctaaggactacagaagaattggaatgaagacaggattttttttgtcaaagaaaataaaaagttctgaccattaaacgaatgcgtttttgtcatagacgtggtggaaaatgccaacaaagtcagatttcaaaattggctcaaagtctcctgagtcaaatgaaaactctgtcaaagccatgttatacttcttcttagtcttttatccatgcattttaataatatagttatggtcatgttatcccaaattcttttcaaatgttgttttaatggctctgtaactttctaccttgtgactattgcatggttgttttgacctttttctcattttttgtagatatttaagttcttactttttttttacttttataattagctctgtaatgagctttttgtgtgaaaaaacatataattatatacagagttattaccttactacagattcataacatttggattattgcatcttgggaaataaatattgtagtgttccttgtgtatatatcaagtttatatcaataccatctatatacttatatatcagattttataaattaaatgtgcaatttattgtgtaccaaatatatttcaataaagctgttttttaacatgagggccttgcacagtagctcacgcttgtaatcccagcagttttgggaggctgaggcaggtggattgcctgagctcaggagttcatgagcagcctgggcaacacagtgaaaccccgtctctgctaaaatacaaaaaattagctggtcatggtggcgtgcacctgtagtcccagctacttgggaggctgaggcagtagaattacttgaatccgggaggtggaagttgcagtgagctgagatcgcaccaatgcactgcagcctgggtgacagagcaagactccttctcaaaaaaaaaaaaaaaaaaaaaaggacaactaacacctttactcttatggcagtaacagagtagcttgttttggagtaatcctatcatagatagcaattataaattctagataggatagtaaaaatcaccttctgtttgatggtactccccaacaaccataagtaggcagaaattgaaggggctttgaccctggaaagagaggtactgtaacttgataaaatgagatgcatttgatattcacccccaaagtacacaccaatccatgtggtgcaaggaagacgagactcaggaaggctacagtcttactgagtttgagaaataaaagacagatgtccagaatagttagaaagtatcaatgaaagacacatagatagactaggaaggaagatgcagatttacctataaaatctacacacattctggtggatctctgaagcatatttatataaaagaggctctaggggagcccgtgggaagccatagctggacgactgaaagaaccgagtggatactcgagttgctaaacaggtagaggatgcagaatgggagtgtgaatccagcaagttaactgcctgctataacaaaaatcagcactcttctgagtaagttaacaaaattcagcctcattaatatattatccatgatgtccttttaaataaaacttactagatgtgtgaagaaacagagaaacattactcatagtcatgagaagaagcagttaaccctgacataaaaaaaatgttggaattaacagataaggactttgaaacagctggtataaatgtgaatagtaattaaagaaataactagttatataaaaatgaaaattttagaattacaaataaaatatttgaaatgacagttttactatatgggctaaacaggagaatggggacagcacaacagatcagtgaatttaatatagattaatgtatatcattcaatttgaaaaaaagcaaatgatttgattattaacagaagactagtgatttatgggataatatcaaatgtatacagctataggtacttggagtcccagaaagaggaaggagaagataatgcataagtaatagttgaaatttcttcaaatttggtgaaatactttcaagaagctcaagaaacttcaagcaagcaaaatataaagacaagcacacctagtatgattttaatttccacgtcatagtcacagtgatgaaaataaaagataaaaacatcttgaaaacaatcagagtgaaaaagaggcatttcctacatggggcatagtgatatccgtgatggtcagcttctcatcagaaacagtggaagcaagaagacaatataatgacgtcttttaatggttgacaaagaaatctgcccacccagaattctgttttcataaaaaaaaaatccttcacagaaattaataggaagatgcattcagacaaatgaaaatagatgttttattaccattagtcctgtactataagaactgtagctttaaagggtatcttcagagtgaaaggaaatgatgctaggtgagacttaaagagatgaatgaagagcagggaacatggtaaatatgtggataatataaaaggttataatgcttctttgaaaatatatgtaactgtgtaaagaaagatgacatcactgttttttggagtttgtaacatatgcagacacaaatgatgagaatgtgaagcaaaactatactgttgaaaattttttacacttgccatgaagtagcactgtattaatgctgagtagactgtgctgtgttaagattacatagttaattctgagagcaactactaaaaatattacaaaagtgtatagtgagaaagatacggaaggaactaaaatgaaataatagatatatcacttaacccaaaatgagactgaaaaaggggaatagagaaacaacggcataacaaaaacaatagtaacaaaaagcaaacagaaattaaagagcaaaccataaacataagtccaactatgtcaggaaacttacaattatggcagaagggtaagcaaacacgtccttcttcacgtggtagcaggaaagagaagtgctgaagaaaggagcaaagccccttagaaaaccatcagatctcatgagaactcaccatcatgagaacagcatcagggtcaccgcccccatggttcaattacttcccaccgggtttctcccataacatatgcggattatgggaactacaactcgagatttcggtatagccaaagcatatcattctgctcctggtcctttccaaatctcatgtcctcacatttaaaaacacaattattccttttcaacagtcccccaaagtcttaacttcttccaccattaacccaaaagtccaagtcaaaagtctcatctgagacaaagtaactctgttctgcctatgagcctgtaaaatcaaaagcaagttaggtacctactagatacaatggggtacaggcatcggataaatacactcattccaaatgagggaaatttgccaaaacaaagggactacaggtcccatgtgagtccaaaatccattagggcagtctttaaacattaaagttcccaaatgagctcctttgactccatgtctcacttcctggtcatggtgatgcaagaagtgggcccccatggccttgggcagctctgcccctatgcctttgtggggcacagccacctttccacctgctttcatgggctggcattgagtgtctgcagcttttccaggtgcacagtccaggctgtcgctagatctaccatgctaccattctgggatctggaggatagtggtcctcttctcatagcttcactaggcggtgctccagtgggactctgtctgggggctccagccccacatttcccttctgcactgtcctagcagaggttctccatgaggattctgccccagtagcagacttttgcccggatatctgggcatttccacacatcctctgaaatctaggcgaaggttcccaaacctcaatgcttgtcttctgtgcacccacaggagcaataccacgtgaaagctgccaaggcttggggcttgcaccctctgaagcaatggcctgagctgtaccttggcctcttttaaccatggctggagctgaagcagctgggatgcaggggaccatgtcccgaggcagcacagagcagggtggccctgggcctggcccatgaaaccacttttccctcctaggcctctggtcctgtgatgggaggggctgccatgaaggtgtctaacatgccctggaaacattttccccattgtcttggtaattgacattcagctccttgttacttatgcggatttcttccaccagatatgcgaaatcatgtctctcaaggtcaaagttccactgatctctagggcaggagcaaaatgccaccagactctctgctaaaacacagcaagagtgagctttgctccagttcccaagaagttcctcatctccatctgagaccacctcagccaggacttcattgtccatttcaccatcagcattcaacaagtctctaggaagttccaaactttgccacatctttctgtcttcttgtgagccctccaaactgttccaacctctgcctgttacccagttccaaagtcacttccacatttttgggtatctttacagcagtgcactccactacctcaataacagcttatgtattagttcattctcaagctgctatgaagaaatacctgagactcggtgatttataaagaaaagaggtttaattgaatcacagttccacatggctaaggaggcctcaggaaagttacagtcatcatggaagacacctcttcacagggcagcaggagagagaatgagtgcccaatgaagggagaagccctttgtaaaacccccagatctcgtgagaactcacccactatcacgagtacagcatgagggtagccagccccacaattcaatgacctcctgtcaggtccctcccacaacatgtgaggattatgagaactgcaattcaagatgaaatttgggtggggacacagccaaatcatatcaggtgatttgaacaacactatctaccaacttgacctatgacatttatagaataatgtatccaacaactacagcatgcacatgttttcaagtgctcatgaaatatcccctcaaagtagactacatgttgggtatgaaatcttaatgcatttaaatttttgaaatattgttaactatgttttctggcaacaatggaataaaattaggagtcagtaattataacgtacctataaaagtaccaaaattttggaaattaaatagaatacttctaaatgactctcacattaatgcagatatcacaagagaaattagaaagtattttggactgaatgatgatatctcaaggcttatgggatccggctaaaaaacagagtgaatgtatagctatagatgctgtaaatttactggttgaaatgttagagagatttaaagtgaataatccaagtttctcctttaaaactagaaaaaaagaaaattatacccaatatagtaaaaggatgggaatagtaaatataaaaacagaaatcaggctgggccttgtagctcatgcctgtaatcccagcactgtgggaggctgaggcgggcaagttacttgaaatcaagagtgatttcaagtgaaatcacttcaaatctggccaacacggtgaaaccctgtctctacaaaaaattcagaagttaaccaggcttggtgggcgcttgtagtcccagctactcaggaggctgaggtgggagaatcacgtgaacccaggaggcagaggttgcagtgagctgagattgtgccactgcattccagtgaaagagcaagactctgtctcaaacatacacacaaaatcagcattgatagtacctgatggtgttggattgaaattggagctatcagtatcaatttagtttttttaaagtatatacataattatagaaatacacaaaacttggaaactccaggagtaatcagcacaactagctcccagatcttggtttctaaatatcattaatcattaaaaggaaccaaaacttattggagaaagggtgattccagaactggggcaaggaaagaacaatatgaacctggaacaactctttctttttgccagaaagtcaggaatatcaaagaatgatgggagcatgtccaaaggacacaggcctcagcttcaagtaccatccactggccagatctgggataatctgagtatcaaaatgtaaataatagcaagagattggagctcactgaatgaaaggcaaatgcataagtgtacactgatataaataaattagaaaatgaaaaattcttcctcacaatataaacactactactaacttataagcataactcacacctgtgaaaatgagttagggtaacttcacttatgataacctcaccaacattggactgtgatcattttaaaacctacgctaatttgaagggcatgaaatgatcttttatttggatttataggactttggatcattaggggacagcagtgtttagccgtatgcttataatgtgtctttaactaaaatatgatcatttttcagtcattttgtagctttcatttacccataccccatttcaaatcccttgtataatggaagccactattgctgttcccagagtgactccattgttcttagacgcagagaacgaaggaagaaatcaaagtttaaagataagtttactgttcatggaaaacattaaatgataaactatagtttatttaaaatagaaaatgattatttcttgggcagctattgcatttatgggatccattttatatgtatctagtaaatccatcaataaccctgtgatggagtaattagagaagagaaattgctattgtttccactttaatgatgagagaagaaaatacccagggagattaagatcgtaactgatcatcatggctgagccagaccagctaactgtcgaaacgttcctctggccccaaccgtgatacctttgtctaatggtggggccagggagaagggtcagaaggatgagatgactggggagaagaaaacagaaaaaaaaaaaaaagcattttcttgtgagtcctgtcccaaaaaaatgctaagcatgcatgcagacacccattcattttatacattttgcttgagtccctgcagtgtaccaagagctaaactaggcatataggaatgaccctgacattcatccccacccactggtctctggggtagaataaacttcggaagcttcctatgtagaggcgaccatagtagagaactgaaatctcaccctttgttataggaggataagagaaaataaacgtggatatttaggtgtgttcttttccaaacaaaataaaaatgaacaaacacatttgcttgcttttttttcctttggatcttttatcttttaatgcactttcattggaattcaatccatacatactgaagggtggttgaagtaataaatacagtctttttctccaaatggtacccaaatgaaagcaaagtactgctttctgcttaagagtgttcagtttgtccttgacctatacatttacactgggttgctgtcctctgcctccttccactactgtccacacaatacctatgtaaacacatacacacacacaggccttaatgatgagtaaggcccatttatttagaaaacatggtttgaaggatatgttaaaatcatttgtagataaattgatatttttatattattacttctttcttgggtttctgcctttgatttagactgtagccagttgtgcctgctatcagttctggaacctaaaattcatgtgggaagaatttaagtgtaaccgagatgtaattgtgattgaagcagggaatgaaatataaacactaatcaaagcttcagtagacatgttttttttgtggattaatacatcacattttaaaaccttcaacccttggcttctcagttttttctgtttattgttttgtttgttgatgtatttgtttaattcatgggttagaggcttgggtgctgagagagtcgattgtgttaaaacctttagtgtggaggtcatgaagaggactgagaatgtttgatctttcactgtgggtgctgaaccagcagcatgagtatcacctgggagattgttagaactacagacttgcaggcctgtattcaaaatctgcattttaaaccaagatactcaggtaatttgtaaacaaaagtttgagaagcactaggtcagtttactccagctgtctaaaccagacctgccactcaggtgttaagaacccaagcaataaggggtggcttgcttttgataatctccctctaatcttatcagagactttttttttaaatagaggattctactcccatcatccaggcaggagtgcagtggtgtgaccaccactcattgcagcctggaccaccggagctcaggtgggcctccctcctgaacctccccagtagctgggactacaggcgagtgccactacagttgcctaattttttaattatctgtagagatgtggtctcactatgctgatctcaaactcctgggctcatgggatcctcctgtcttgacctcccaaaatgctggggttgtagccatgagccaccgtgcctgacatcagagacacttctgatgagcccaatatatttctaattattggaccctcaagtgcatctggagaggacaccgaaggactgtggaggcatcgagccctatgttcatgcattgactcaagtgtgtccctccaaaatccatgtatggaaaccctacccctgagaattactatatttgaagattgggcttttagaagataattaaggtccaatgagattataagggtggggtcctgattcaataggactggtggcattataagaagaggaagagacacagtaggaaggtggctgtctgtaagccaggaaaagagctctcaccagaatccaaccatgctggcactccaatatcaaacttccagcctccagaaatctgagagtgtaaatttatgttgtttaactcacctagcctatacagctggctctccatgtccatggactcggcatccatggagtcaaccaaccacagatcgaaaaaatatatattttaaattgcatctatactgaacatgagcagattttttcttgtctttattcactaaacaatacagtataaaaatttatttgcatagcatttgcatttgtattaagttttacaagtaatgtagagatgatttaaagtatatgggaggatgtctgaaagttgtatgcaaattccatgccatttgctgtcagggacttgagcatctgtggattttggtatctgtggagggtcttagaaccaatttctgtggctactgagggaccactgtagtatttgtgatggtagtccaggtactcaaggagagttcagttacaaatgcaattttcccctaaagtaacttggttccaaaagagtacgcatttgtagttgtatactacaaatggagtgcgtgtgtgttctctactctaatatttcatgccagagtgagttattagtttttgatcctttttcttctttttccttcatgagcagcagtcctagtttgcttgggacggggaggttttcatggacgcatcatcccttcagtgctagaacagggagagtaccaggcaaacttgggtggttggtcaccttttgctgttcccagattctttcctgagctgaagatctcagctcccttatgagaacttcacattgcttcaaagaagagcagatctcatcagaatccagcaatgacatgaagcattttggtgcagagtaactaccagattagagctcctggaatacttaaaccttcgtggatccccgatatggaaggaagaagcctggctatcctagcttgaatggaattcagcattggtagacggaaccacaaatgccttctatttcttcccaaatatccttttagaacttcgaactaattctagatagagtcttaaggtcaggtataaatgaactgctaagtatttatgcctgcataacacaatgatcaagaggcttcctgtgagcccaacattctcatgctttaatagaaaacttattgtaaaatttgcactctactctataacatagaaatgtctatcatttctataaatactatgcagtctcttctgatatatctgttatcctatcatacaagagcagatggctgggattttatcacagttagagggtgttttgagatgggctgcaaatcctctggagaatttgatttggagactcaattagtcatgacaagttaggttatgctgcagtaacaagttggctcctgaatctcaatagcttcataaaacaaagctttcatatgtccagtgttgggcattgggaagtgcaccaaatagtgcctcagggactcaggctatggaggcttcaccatcccaccaccgtatcatctggacacacaacttcctttgtcagcatgatgggaaagaaaacatggagaattgtacaccagctgatccatgcttaggcctgcaagtgaaactccttggtcagaactagtgaaatggccccacctaacaaggtggaatgagaatgctgctcttctgtagccataaagggaaggaatagcaaaaatgaaagtgaataggcataatatctaacacaagggtccaagaggtagaccctatacatgacaaactgtaattccacagaacagctggagtcattgatttgggaactagccactttacacatgggctatttttacatttgtttcaaggagtagtggcagggatgtattatttaataatgatcaataaaactcataaaatattgagggagaaaacaacttctattacaaaatgcaatggtttaacctcctttccacagaataaaattgcaagtgcatgagaattatcacatatgtccaaggatacacatattcctaccttggatgctcacatactgtgtgcaggaaggtgagaacgcagaggaattaaggactcagaacttgtctcctctcattaacagccaatgtctcacatatgtcctggtggatcttacagggctcagcctgaatgcttctctaaacttttccacatgtagtaaggctaaagaccatgtgttttacaagatggcaacactcaatcctatgcttttcactgaaacagaatgctctgtcattgaagcatttctctggggacctcagattctctttacagaggcaatacccattaattctaatgcagcctcctgtcatctgggactcatgaacttccaccgcagtggtcccttcctataatcaaactgtagtagcttctgtctccatagaagatgttagacatgcccagaaacctggtatgcaatgtcacactctgccaaaagaacataaaacttagacaaatatggaagtcattaacactgaagagttctttgctattaaaaataggaaaattttattactttcctacatgagaagaatatataatacctttagggttatttggtcatttggaggctagcttcttttctctgtttgtagacctatttttggaagtcgaacattttttttttttttcattttaagcaccctattgatacttggcatctctgcagtaatagaattttgaagagttcatcctgttcctatgctcggtcaatttttggataagtctgaaaatgatgctgtggatagaggatgctgggacccccatcatggcaagcatgcatcattgcaaagggtcttcataaggttatgtggaggctacctggggtcaggatccattcagagctggaaaacttaaatagaccaactgatgttagaaatagaatagatccatggcttgaaatgaacagttgtgtgtttatatgctggctgacccccctactgactgtgtgactacggaaaaaacaaaactctgctgcccatcggtaaaatgggattatgatccttgcctaacttcctgtttatagggttctggaggtcccaatgagataaactcttttgaaagaggtttggaaaatgatgcattatttcacaacaacatggtgttacggttgaatatcaatgatagagagtaattgagatggctatgtaacatagtggccagtcatccatttgcctagcaaccatctatattatttgtatctgtatctatctatatgtctatatgtctatacatctataactatatttatatacctacatccttatctgtatctgtacctttatctatatatatgctatggatttgcctatgtccaagtctatatccatatcaaatatgtacatatacattttctatatatgtaatccatttctatctctatatgtctatgtatatatctatatctatatctttacctatacctatatgtatatatttgtctttgtgtgtatctatgcttatatactatctctatatttatttttatgtatatctatgtctgtatttatacacacacacatatatatagagagaggcagagacagagagaaagagaggagaaagagggaaggagaggggtgtgtgtgtgtgtgtgtgtgtgtgtgacagagagagagagagagagagagagaagtacattctatcctaggaaatgggaacagagccataatcaaggcagcatggttttgacttatagttcccaggagagactttcattaaacaaaaatatcttgaatgaattgcaattgtggtaagtgctatgaaggaaaagtacccaatcacagtataaatcttatcccagcagggaccatcagggaacacaaaagaaataaaacactaaatcaccaatcctcacgcagcatacatggaccgtaggtgtggaccccagcctttgtgagtagatccccactatgttctgaatgttcgcttttccccagaattcatatgttgaagcctgattctcagcacaatagtattaagagctggaggctttaggaggtgattaggccatgagggtagacctctcagtaatggggtttgtgcttttatcaaagaggccagaggaagcttgtttacccctcccatcatttgaggacacacagaaggcaccatctataagaaatgggccttcactggacgtcaaatctgtcgacaccttgatcttggacttccctgcctccagaactgtgagacatgcatttctgttgttaataagccactgtgtctaaggtattttgttatcacagctcaggcagacaaagacattccctaaaagaaaagcactttattctataaagtgctgttgtttgagcttaataaaaagttaaaaaggccctttacagaggtctgtcttaaggaataaggtgtgtgtgcaggggggactttaattaccagtgggatgtatttaatgtatgatttcatttagaatccgggagccaatggttagtgttttttaatagactgaaattttcatcagggcgagttctggatctttatgcagctggtgctcagctcatctttgacctgcctgggtccttttctcacccattccatggtgggaagcagacactttgacttttcagagcgttattgatggaacaaatgtagtttgaatgagcttattagagtgtctatgaagtgtcctctgttcttaggcaacaaggccagtttctctcctcttccctccctctctgacaccgtagtgttatgttgtctgtaacatgttttgttacggttttagcaagttttcaaggcaaagggcatggcattaggaaaattgaattcacaggtcaaacaacaagtcaggtgacctcaggaaaatgacagtgatttgtgtttgcattttaatttaattcagtcctaaaaatgacccatcttgctgctattttctgtgatcacaacttttatgttttcttgtagctagctcttcatgtaattaatcattgcatgaatttctattttatcattttcttttggtgtcgttttaccaccccttctgtgatctccctgaaggtagaaaacttttctgttttgttcatcaatgcatacttaaagcctaacacatatttgacattttataaatatctgtgacttgaataaatgaataaattcacagtctctccctacatactacttcaaatactaatgttttataacaaataaaagtttactgtctggacgtggtggctcactgtaatcccagcattgtgggaggccaaggcaggtggatcacctgaggtcaggagtttgagaccagtctggccaatatagtgaaaccccatctctactaaaaatacaaaaattagctgggcatggtggtgcgcaccggtaatcccagttactcagggggctgaggcaggagaatcgcttgaacctgggaggcggatgttgcagtgagccgagatcatgccattgccctccagccagggcaacgggagcgaaacccggtctcaaaacaaaacaaaacaaataaaactttaccaaacactttgaaactggaaaaccttaaagttgttttccatttgaaagttaagatgcctttgagtgttaattacatgagtctgttcaattgtatgttttttgataatatacctccatgaaaagttgtgggatttttttaagctaagacacatgatttaaaataccctgtgaaacttttaaaaaggaaagaacctgaatgaacaaaataatatggtccccaaatggctgttgtagtggaggggaaaaaggtttcggctaaaatttatccagctgcaaaccactgtcttaagccagcaagaaatttatattcttccgaagctgagggaaaatcaaaatccacaagtgactcttctcttcccctagctgcttcatacactgctcagtttccggagatctgagataatcattttgtccttgagagtctcgtggctgtgctcttggagggtttgggtttaaaatcttaggatttgatcctgttcagaaaaacaaggcaggagcacccgagaagcatctaaaatcagccactgccagaggctgcttgctttacctgtcttgcctgttcaatttgtcctctacgaggcaaaggtgagactaggagccctgcttctgggaaaatgcctctgttaaagaaccatctcacattcctggagtttgttttgggatcacaaaattggcaactttcttttcttcttcattgcagtttagagttttaagcatcataaggctgtgtgtgtgtgtgtgtgtgtgtgtgtgtgtgtgtgctggtgcatatgaatgtgcttttacaggtacaagaaaataaataatccaaaggtagccttctccttggggtgtcctgctgaaacgatgacctagggttcttttttttttttttttttttttgagacagagtcttgctctgttgcccaggctggagggagggcagtggcgcgaacttgactcactgcaagctccaccttctgggttcaggccattctcctgcctcagcctcccgagtagctgggactacaggcgcctgccacaatgcacggctaattttttgtatttttagtagagacggggtttcaccgtgttagccaggatggtctggatctcctgacctcatgatccacccgcctctgcctcccaaagtgctgggattacaggtgtgagccaccgcgcaccttctatttgaggccctgcgctaggaggactgcattaagaccaaggcgtgcggaagcacactgatgttgctgcctctggtgggtgcacgttgaatcacgtgtgtctatccaagaggaatttgtattaacttctagtgcatttggccagaaaatgccatgagaatcagtggaacatgctgtgtaggctgttggagtggaaacaaacctacctggaagtaggcactgtggtctgcaccattcggcataagtcacttagcccctctgagcttcaggtttctcagcgcacagttggggataaaaaggaacatattactcagcatttgtgggctggctaaggacacagcaggcattacctgaacatccccacaataaccccgggatgtagttatcacttcccttatcgttctcatttagacagaagaggaaaccatggctcccgctgctcacaggagaagctagtattattcccctactctgaaaaccaactggatgtcccgcaatcatgggaatacaggtgcaacccatcacatatggccaattgtttttaaattttttttgtagaggtggagtcttgcaaagtggtccaagttggtcttgaacccctggggcaagcagttctcctgctgggacctcccaaagcattggcattactggtgcaagccaccacacttggaccctttttatctagataaccataggtccggagatgactgtgacaaaagagccatgtgctgtacatagcttgatcaaaatggcaaaaatgtatatgtttatgactgctgttttgtgtattcccgatgaacacatgcctttgttgttgattcttcatctatcttccaatacaattttaggtctggtgataatttctggatttctctatttatagaaaactttgaacttcataaatattaaaatgtcctattagctacatgcagactgctttttctatggccatggacattatgcaattattacccgagctattaattaaatttgaaaatagataaataatggatagggatgctatttatgagttaaaagtgagaaaatgaaaattattctccattctgttaccttggatgagtctaacctactgcatgctctcagcttttattattgaaagtcattatgttactttgcataaaatgaacaattggttgtaacaagtcagccctgtacagtgaccagttttcagatgaagtgattaaaatattttctcaataaaacaatcaaaacatggcccttggccaggtgtggtggctcacgcctgtaatcccagcactttgggcggctgaggtggtcggcttacgaggtcaggagtttgagacaagcctggccaacacagtgaaaccctgtctctactaaaaatacaaaaattagctgggtgtagtggcaggcgcctgtaatcccagccactcaggaggctgaggcaggaaaattgcttgaaacccgggaggcagaggttgcagtgagccaagatcgtgccattgcactccagtacaggcaatagtgcaagactccatgtaaaaaaaaaaaaacaaaaaaacaaaaaaacaaaaaaaaacatggccctttcacagtagtcaaatactgggtaatttccatattatacgagttagaaacatgaatctcaccagagaaaaggtatgtccccaagaacagagtgaacatgtattttgggagttactgcagaaagctttcatgaactctttctgataatataatgcgctggtagatttcctctggtcaacttggatttcagtcttccgtttctaccttttaaaggaggccttattagtctctctggttgatagaggatgcctgtttgttcaattcacactattcatggacccctatatgcctttcaatgatcatcctataaaagttatctttccactgcgtttactagatttgagttatcaaatggaaactctcaccaatgtctttgaaacctttttgttttcaccatgcctcataataagaaatacattttacattgaggcagcatgcacctgcaataataagcaagcgcttcacatgcactttgatgtgctccattttatttctttttagaagaaaatgttggtcacaaatgacactcccagttttgtggctgctaatggacatgtgaagcacttacttagttgtctcggaaccatctaatgatctgattcagtgagcaagagtgtggaattgtgagcccgacatgcttacacatcagtctttctgctgttccagagttactggagcgtgcacctggcatttgttgagtctctctttggatggtttgtgtggcactatcagaaacggaactttcaaaaactgataattttggaagataaataattatggaatactcttgcctcagatactttaatattattgagaaaaattacaacaccaggctcagctatttttaaaaaaaatttttggccaggtacagtgcctcatgcctataatcccagcactttgggaggccaaggcgggtggatcacctgaggtcgggagtttgagaccagcctaaccaacatggagaaaccctgtctctactaaaaatacaaaattagctgggtgtggtggcacatgcctgtaatcccagagacttgggcggctgaggcatgaagatcacttgaacccggaaggcagaggttgtggtgagctgagatggtgccattgcactccagcctgcgcaacaagagagaaactacatctcaaaaaaaaaaaaaaaaaaaaattgtagagatagggggtcttgctctgttgccttagctggtcttgaacccctgggctcaagcagtcctctcatcttggcttcccaaagtgctggggttacaggtgtgagccactgtgtccagccaaaatttatttttaatagataatggttaggacagtgaaatttttagtcggctatcattgcaaatgactgtttgccatatgaaacctgtgcttttgaaatgagggtttttattctcataatcggtcaaaacaattgacagagaaagaaagaaagaaaaaagtgtttgtgaaaagattctaaataaagagtgcattgaatgagagccattttgttggaagaaatccaggatcttttgatgtgactactggaagaacaagaccacatgaaggtttatcttttgatacttaattaactaagaatcaggtatttctcagtctctcatctacagctctcctctacacactcacactagcccctgcatgttcttttttgttggggggaactatggcgacaactaaaggctgaaagagttcaggagacaaagaggaactcttagcgaggttgatggggacctgcattttaaagggtgaatgcatgttctccagctggccatatcttaaaggctgagcacatattctataggtgcacatagacgagaaggaaattccaaccatagggatcgttccgcgcaaacacagcaagtgcaagacctcagagagtgccaagaacacccaagtactgtggaaaggggctggaggaagatgcctcccaagagagccagcacaggcccttggacaatgaaaaactcttggaggctttttaagcaggggaagatgatctgatttccattttgtgaagaaccttggaaaggtggatgaaagcagtgtttctaatatctgcctgaattgataagtcaagtcacctaatgtacttgtgtatgtagacatatgtacttatatatgtatatgcaatttcccagtcctcttctctgggattatgtgtatggaatttgtcacatccatttgcgcatgtatttcccgggcacctactgtgttgtctactctgccccaggtgtgggaattaggcagtggccatggccagtaattctgatcctcatccatcttatgtgctgttgggagagaggcagatattaataagcaaacatctaaataaacaagatagtttccggcagtgacaagtgcaaagaagaaaataaagtactgtgtaagttcgttaagcaaaggggtctcattcgattcaagcttatatcccacccaaatatctagcaccatgtctggaaaataatgatagctgtgcccatggattgtagactgtgtgccagtcattgtcaccggccctgtacatataatacagtctctcttcaaaaccactctacaaagcagggattcttacccagggtcaattttacttttagtggacatttggcaatgtctgtcttgagacaattttcattggcacaactggaagaggttagggagtgctgctgacatctagtggatataggtcaaggatatagtcagacatcctgcaaggcatggggtaggatgcagagcaaagaatgaaccggtcccaatatcaatactgttgagtcttactggccaggcacggtggctcacacttgtaatcccagcactttggaaggccaagacaggcggatcacctgaggtcaggagttcgagaccagcctggccaacatgatgaaaccccgtctctactaaaaatacaaaaattagctgggcgtggtggcatgtgtctgtaatcccagctactagggaggctgaggcaggagaatcgcttgaaccagggagtcggaggttgcagtgagccaagaccatgctattcactctagcctgggtgacaagaaagaaactctgtcacaaaaaaaaaaaaaaaaaaaaaaaatagcgttcaggttgagaaatcctacagtgtaacagggtactagtgttaccccattttcaaaagcacaaaagatgcaggtgacttaagtgataagcccaagctcatacagctaggaagaagatgatgcgtttaaaactggagagtctgggccgggcgtggtggctcacacctgtaatcacagcagggagagatttgggaggtcgaggagggcggatcacgaggttaggagtatgagaccagcctggccaatatgatgaaatgccatctctactaaaaatacaaaaattagctgggcgtggtggcaggcacctgcagtcccagctactgtggaggctgagacagaagaatcgcttgaatccgggagatggaggttgcagtgagctgagataacaccactgcactctagcctgggcaacaaagcaatactgtgcctcaaacaaaaaacaaaacaaacagaacaaaacaggagagtctgtgtgcagagctccaatatgtaacccccacaacctcaggatatctgtgagatacacaaatgcagacgcaaatgactgttctgacagctaacgtagggacttcgaagtctctatcggtgtgaaaaataagaaacattttctgcagatgggtgccaggtaagatgggttcactttgaggaccttggtttaatcaggatatcaaaatttgttgtttccttgtgcttgtcacaatatcccattgttaacacctgccagcgttgtcatcctaaactgttgctgctgtttctgagatgagctacaacaggtgtgccaaatattgggccattagcaagcggtaattcacctgcatgaatatttatcgtcttgtaaggaggaaacaaaagccgtgtctactttttggaacatggtgcagcagtgtcctcgaaaccaaattgtttgagtctctcgcttatgcggaaggagaagggctcctctgtaattttccatcgggtggatttattttctcagccatctccacatcaaaacacaacactgacaggcgcttgattttattaagccggtaaaatcacccgacagtttagatagctcaagcctctgattatcaaaatatctattcttaaactggttttgaagccagtcgcttctccatggggaaatggccacaatgatgagcaggacaaatttttgcttttctcccctctaattccttccctccctgcctcctccttctccttgtcttgttctttttttcgttccatttttctttttttactgaaagagattgtattaatgaggaaagaggagaaaactcagaaacagataagaaagagtggcaccgaggcttcttgtacaagggtgattgtaaattttatgtcctcagtaagaaccccaaggcgtgtgtgcttttaaacaaaaagaaagtctaagggagaatatgccatttccacgcccatgttactgctgcattcgcacctgtcagcactgcggcctgtacctccttgtccagcaataccatactaataacataccttacaggatacacggatacatcaaacaggttgcagtgctggtaatcactgacttagaaaccaaatgtgctgtcctgaatttttaagtattgccatgactaaggaagtaatgatggattcccaataagtgtgtttgccatttgtgtttggatatcatcactaacagtaactttctgtgcatattttatggtgatcacttatgggatcattccttaccttaaatttgtgcagatcattcctctttctttctttttatttttttgagacagagtctctctctgtcacccaggctaaagtacaatggtgcagtcttggctcactgcatcctctgcctcccgggttcaagcgattctcctgcctcagcctcccaagtagctgagattacaggtgtgcgccaccatgcccagtaaacttttgtatttttagtagagatggggtttcaccatgttggccaggctggtctcgaactcctaacctcatgatccacccaccttggctgtggaaagtgctgggattacaggcgtgagccaccatgcccggctgaattttcacctttctttccctttccatcggccctctctactgattctatgtttatacttgatcaaataagagtttcagttagtcaaatataaatgtgtttactttttttttttttttttttgagactggagtgcagtggcactgtgttggctcactgcaatctctgtctcctgagttcaagcaattctcctgcctcagcctcccgaatagctgggattacaggcgcccaccaccatgcctggctagtttttatatatgtagtagagacggggtttcaccatgttgtccaggctggtcttgaactcctgacctcaggtgatccacctacctcagcctctcaaagtgctgggattacaggtgtgagccaccatgtctggccttaaactcctttctttttaaaaaaaaaaaaaattaagttcaagggtataagtgcaggtttgttgcataagtaagcttgtgtcataggtttttttttttttacagattatttcatcacccagatattaatcctagtatccgttagttatttttcctgatttacacatgtaaatcattaacctaaagaaagcaaaagacagaactttcttctgagaaaggatgtatgttttcccttttggaaagttgtattaataacatctaatccttggggagtgctcagaaattattttctgaaagaatgaatgaatgaatgatcaagatcaaataagagacacaggccaagccttcaaacaagttatactgaacccagagggttccctcaggctccttactgccatgactaagtacgaatggtaagtaacatttgctaaggacttactggggagtgtcatggtttatgccatttaacctcatgagggaggcacttatatttcccctattttaccgaagggtagctgaggcttggagagaccatatggcatgcccattttagccagtgagtggccgggtctggaaataaatctaggaggtgtgtcctttaaccactttgtagaaccattctcattatagtaatggagaaagaacagaatctcttatggtgacttctaggactaagggcacataataagagctgctatttggggaatatgtctataaacctgggagttataaagtagggtgagaaatgggggtgcattatgatgttatctgagagggacttggaattcacatcatctacaattttggacagatgtctttctgcaagccttattttttttttttttttttttttttgacagagtctggctcagtcacccaggctggagtgcagtggtgcaattataggtcattgcagcctctaactcctgggttcaagtgatcctcctacatcagccttctaagtagctgggctacaggtgcatgccaccacacctggctaatttaagaagtaaaatttttatagagatgggatcacactatattgcccaggctggtcttgaactcctggtccttaatcagtccccctgccttggcctcccaatatgctgggattacaggcatgagccaccacgtctggcccttcatgcaagtttgatatgcttttccttcactggggctttctccctgagtattacctgaaagtcagaaaggtcctatgtggaagaaccgttgtattgcaattactggggagcagaaggaaagtgattttggaaaaagcgtatgtatgggcttggaaacttttccccagaacagagaccatttgcagacttttcactgtggccgtttctcccagtcttgatagcctttcacacatctccagggttatctttgcagtgactcagtcattattctacaggccagcatgatttttcttaaattttctaaacctttttccaaaccttcaattttataaaatgtgacacacattttgacttcttttataagacctaattcgaatgccccctcctttttgaagcactccatgatttttttctactgtccaggtatatgctgtggtatcgtattgcagagtcattactctttgcctgactggcctggaattgcctgttgacatacagtttccctgctggaatgtgtgagctctctaaaaagtgtggagtgtatggcttggtttgttcattcttgattcatcactcacgtgtgtctctaagtagcagctgctcaataaacattgaagggaggcagagacaagacagtgctaagaaaggaatgaagacaataagcaaaagttaattcaagtacatttctaccaaatttccggaaccagattcctaagcagtggaggcagaggagaatgaaaaggtagagtgggccccgtgccaatttcatttcagaaaacattcagagagatgcttccctgcgtggtgtggttgcagagggcccacctgtacatctgggatacctacaggcatcccaccattcccgttcttcatagactatatgacacatcccagtcgtgttctatcttttacacgcagcacacacaccgcaatttttgccttgctgagcttttaaaactcttattatctcagattatgaagacaagctgtgcggggtataggcatgatctcaaactgagttaattgaaggtggaggtcagttcagctttcctggaccatcaatcagtaaaaagtttacttgtttaatgcacggagagtcaaagacatgctgcaggcccccccatcccttcccttctggcctgtcaggtagatgttagatttcactgagctgttaaaaatcttaatggatcccactgagctgtttcaggttgtttgtgacaatcacttaatttccttgttttgcagctaacaatgattttaatcttcatttcagattaaccacataaagcctcagtgtccttttctcccgttgtcttgcctgcttcaactctgcagtcgatgaaagggagaactctttccctttctcttcagcagagcctgaaaaaaatgtaccttcagcaaaattatagatgcagtaatttctcatatatgttaaaaatgcacagtagcaaagactggaaatccagcaaagtagtagtagcaattgcctccaggtggttagagtgtggggagattttttttccctacctctttcattttttatttttttacactttcaacattttctgtgatgcactttataatttttacaataagaaaatgtaaattaaagaattggtgtttctgaatcaaggatgaacaaagaaaatgtagtcttttgaagagatgttaagccagatatttttctactttaaagggtggagaaaaaccacatcgggataaaagagtgaggctgcagaattagcttgcaacttgaaggatgggccctattacagataatgctgctgacagcctcagttcatcacgtttctcatttttagtgtattggtgtttgctcatatgaaagttcccagcttgtgctactaattatttcatcaccattcacttgtacaattgacagcctttgaaccaatatcagtgcagagaccagagaaacgattctgagagagatgattcaagaggcaaagattggggaaatgaagaagacttatttggcactctctgagtgctttatgtgtgggatgagggtgacatagtgcaaggagtaaatagtgttgtcattttaaaaggctagacctgcatcaaagggcacttactgtaagcctgaaagtgggtggactgaagggctctttcttccaatggccccttgttgcagcgtgaacatctcccatctttatattgtgatggcactattcctcaatggctaattgctaggcaatagaagacataatttagactccaatttgtaagtcaatcacatgaaggctggatgtgagcaagcttggagataaatgaaccgtggtgtaaacaagagaggcccagaggcttcttgatccaatttcaggaatcccaggctaccctgatgcgttggttgagattacatcctctccttcgggaggggacagagggcagcccgcatctctgctcttccatctggagccgctctctatgggagaaggagtcttgagccctttgttggctgttgatttgatttttaaaaggaaaatctgacaaatcatgttgaatgagaaaagcgtattatgtgaacgtaaaaacgtttgcacatctgaggaccacgcgattttattcaaggaagttctacctttaaggaggttatgaattctgaatcagaattttgtcgtcaggggaatgcttcttagaaggaaggaaatgtactttttaacaagattttcagcaaacgttgacacattcattatggccatgagcatggaggtggctcaaatatattttgcataatgtggaaataatattgcattctatttgttcctgcctcctagcgtcaccacgaatgacactggcacagaagaaaacatgggtgctttagatcacacacacaaaaaatgatcgggataaatttaacacactaatcatcgtgaaggggcttctccatgtatcttttcaatacgcaggtttatctcaaccttggcccagctctgtgcagttttataccataaacccagtcagactccgtcttatgctaaaagacctcccccctcctcagtcacaaatcccatcaaatagactgtggtcccatttcctggtcctgttcctcctgtttagggaccagaccttttttttttttttttttttgtggagtctcactccgttgcccaccctggagtgcagtggtgctatctcggctcactgcaacctctgcctccaggattcaggcaattctcctgcctcagcctcccgagtaggtgggattacaggtaagtaccaccacgcctggctaatttttgtattttgttagtagagatggagttttcccattttggcctggctggtctcaaactcctgaccttacgtaatctgccaccttggcctcccaaaatgttgacattacaagtgtgagccaccacgcccgaccacctctccttttttttttttttaactcaactttctttagattcaggggtacatgtaggtgcaggtttgttacatgggtgtactgtgtgatactgaggttcggggtgtggatgatcccatcacccaggtagtgagtgtagtacccaataggtagttcttcagcccatgccctcctccctgtctttcccctccagtggcccccttgtctattgttcccatcttatgcccatgtattagttcacttgtattagtccattctcacactgctataaagaaatgcctgagactgggtaatttttaaagaagagaggtccatggttctgcaggctgtacaggaagcataatggattctgctcctggggatgcctcaggaagcttccaatcatggcagaagacaaaggcggagtaaggtgactcacatggcaggagcaggagcaaaagagaacaagaggggcggcgctgaacgcttttaaacaaccggatctcaggggaactctttcactagcacaaaaatagcaccaaggggatggtgccaaatcattcctgataaatccaccgctgtgagccaaccacctcccaccaggccccacctccaacattggagaccacaatttgacatgagatttggcaaggacagagatccaaaccatgtcaaatgcttagctcctacttacaggtgagaatatgcagtattcagttttctgttcctaggttaattcacttagattaatggcctccagctgcatccacattgctgcaaaggaaatgattttcttttttatggctgcatagtattccatgctgtatatgtactacattttctttatccaggccaccgctgatgggcagctaggttgattccatgtattcacaattgtgaacagtgcagaactctcctttcatcattgtttttcctcccaggttgctgctgttcacttctctgtccagtctgtcaacacccaactttctctgataacaatacagtgtttgttgtatctgaccaacattttgttcggccttccgcaagctgcagagaaactttttgagagtttgataataaatcttgccatgatccctgtaggaggcacgtcttcctgaccaggcgtggtggctcaggcctgtaatcccagcgctttgggaggccgaggcaggcagatcacctgaggtcaggagtttgggaccagcctgggcaacatggtgagaccccgtctctactaaaaatacaaaaattaaccaggtttgatggtgcatgtctgtaatcccagctagttggaaggctgaggtgagagaattgctcgaacctgggaggtgaaaattgcagtgagccaagattgtgccagtgcactccagcctggctgggtgacagactgagactctgtctcaaaataaaaaataaaaaaaaggaagtatgtcaagtatgtcttcctacacaggggagcagagaaagaccaagagcaagacacagtggaggagcagcactgatggagagacatgccccagaggacgtggggaggtgtaggaatcccagccgccagatgagagttcagctacgacgcagcactgcaggcccaggaaggccatggtccagagggaatcagaacagaagagaaatgaggagcccagataagagatccaccctgaatcctagtaacacacagagggcggggagctccggtcttgaggctaggaaacagtcttgcatttgggcaagttgtccttgtatgaagtgccagttgtgtccaggcgtggtggctcacgcctgtaatctcagcgctttgggaggccgaggcaggtggatcactaggtcaggagttcgagaccagcctggccaacatggtgaaaacccatctctactaaaaataacaaaaatcagccagatatgttggcatgtgcctataatcccagctactcgggaggctgaggcaggagaatcacttgaacccaggaggcagaggttgcagtgagctaagattgcaccactgcactgcagcctgggtgacagagcgagacttgtttcaaaacgaaacaaaacaaatgaacaaacaaacaacaacaacaacagaagtgttgcctgcattaaggaggcagtctaagctgtctggcaacttggaggacaagtatcaaagataaattgagattatgtctcattccactgggtgcttccattataatattgcagtggttatcaataggcagtaatcccgtgtcccctggaggacatctaaccatgtatggaaacatttctaaacattaaaagtgaaggaaaggggctccaggaatgctactgctcagcatctttcaggacagccctcactttaaagaattatccaacttcacttgttaatagtgctgaggttgagaaaccctagtacatcttaagagcactgtgtgtgtgtgtgcgtgtgtgtgaacgtggggagataattataactttgtaaagatggatctacaaggatgttcactgcagcattgtttacagggctaaaagcataagcaacctcaatgttcaactatagggatgtggaaagacatgtaataattcctcttctaagatgaaatgacgttgcaaccatggtaaataatgccttaggttaaggttcaatgggatggaagagtgttcctgagatgctattaaatggaaacaaacaagttatacaacactatttgcactatgttttactttcgttttgaaaaggctatctatagatatttgtatttattgcatctaagtcgacataccaaacagaatacaggaaaaaatactctacaatattattattacttggatattgaagatgtggatgaactaaatattttcactatgtgttgtttaatatctttgcagatttccacaaataatttatttgactttaataataaggatgaaacaactttataccttttagtaatattatttttcaaagcatggagctgaaatctgagtagatagaggaaccaggattttctgtcctgggttgattttttagccagaatctacttccatatgcagacaggaaggagagtatggtcaacaggtatgaagtttggggagggtaacattgggctctcactttaagcattgatagctaagctgaaggaggaatactctaaaatcattgtcttctcatttaaatgctcttgatcaaattaacagcctctcctgaatattccaattatattaaaaatggcagtagtgttcaatttgccttctgcacaccccctacccaacctctcaccatttctgtgggcttgggattaggcggtgctgtgttgtgtataagggtcagtcttatagggcaggagcctgggctaatagaaagactgtgacttcatgttcctaccaaagaaaaacaagtttatctactgtatgtggtttatcactattttttttttgtgaagaaaattgtttgttttgaaaacagtttgatggactttgtaggcatttctgtggggaagatttgtattgcctggtttattctgtggatctaattcatacacacacacacacgaacgttttgatagagtttgcagagtttgcttctgtttcagaaggtttaaaatttcttttattcagggagaaagagtttaatcaccattactctttttacctttttatggagggaaaatttacatagcataatgtcaatcattgtcaagtgtacaattccgtggtatttagtacattagcttcccaaaaagaatcccatgcctattaagcaacccctccccatttacccctcccccagcccctggctaccactaggtacacctcatctatttaatgttactgaattgtagaatcttgttggcattttactttctattgtagctagctgtttctctgtctctctgtctcattttctccctctctctctctctctctctccctctcattgtctctctcttattctctctctctctgtctctctttctgtctttccctccctccatccctcctcccttccttccttcgttctgtccctctttccctctccctgtctatgcaatagacaaacatagaaaggcaggttcaaaaacagatggggagatgaagagaaagagagaagggtgaagaagggagagagagaagggagaagggagagacagaagagagagaaaatgaaagtaagagaaaaagagggagggagaaggaaagtgtccaggaaagagagagaaaagaatgcagaggacaagaggaggggaaagagataatctaggagtcggagaaaggcagggtaggttttgaaagaaaggactaaaataggcctggtgtggtgatgcacacctgtcgtcccagctacctgggaggccgaggtgggaggatctcttgagcccaggaggccgaggctgcagtgagccatgattgtcccagtgcactccagcctgggcaacagaacgacaccttgtctcaaaaatcaaaacaaacctactccttctcacaggcacacctcagaaagaccggcagagaggcccctatacccccattgagacagaagcaatttgaaagaactgttctgaaatttcaaaagtgtctcatcatccagagaatgaaaaaaggaaagtaggttagacctgtcttgacctctgcaaattcctgccacatgtctcctgggttctgcccatagcaggctctagctctcagtggtgtaaacttcttgagcatttgggggtcacgctgtcatccctggagtcctttcgttaatgtcctgaaaccaactctccatcagtgttttgccttttcagtattctatctcgctgtataattgagtttctgtgattccaatgcagactatggcatgaactcctgtgtgtctagttattatagattagccctgctgatattatgaggtagggaagggttgatatgctgtagagtgacacagaaacccgataacaatgggaaaagagagtttcatataaatcttcttaagtatagtatttccatattaaatgttataaagtgaaggtctggctgcattgataatgtgccctctgctgatggaatgtgcttctgccctcttggcaggcttcctgtggatcctaggtgataaaagccgtccagagtatttcttcattatcatcgtcatcttatgtttacattattctccttgtcactgagaactccagaccccagtctataggaaacggttcccacattgttgaaatatggctggtggtacagggagtagttctgaacgctgagcatggcctcatttggaatattttatgcaatgaaagtgccggtgagaatttagacagcaaagcttaccagtatgaagcagaaaaaggcaaaataaagaggcgtatgtatggacattgcattcatgcatttgtgcccaatggtgttgaattctccttacaccttaatgaaagagtaaaaatgttgaggaggacgtggagctgccaagtaaggtggattattttttgcaaacaattgtattaccattatgatataatgtattactagtatgatataattctatctgccatgatgtgatatgatttataatgatttaaacagttgtattatcagtgtgatacaatggtaggatgatactataaagagatagtgatttcagagtattgcacaacctctgaagccatttggcctgagttcatgctcttggttcacccgttaccaggtgtgtgactgggagcaaatcacaccctggtcctcagttttctcatctgtaaaatggaataataaggataatttatagtattgctgtgagggctcaggagttaatgcatgaaagcacttagaaatgtgtttgatgagaggccgggcacggtggctcatgcctgtaatcccagcactttgggaggccgaggcaggcaaatcacttgagcctgggagttcaagatcaacctgggcaacatagtgagaccccatccctacaacaaatacaaaaacacttagccaagtgtgctggtgtatgcctgtagttccagctacttggaaggctgaggtgggaggatcacttgagcctgggaggcagaggttgcagtgagctgagattataccactgcactccagcctggacaacagagggagaccttgtctcaaaaaaaaaaaaaaaaaaaaaaaagtgctcgatgcctagttagcattccatacattgactattaccattttcattattattaagttcatgtactgaaaccttcaataaaagcagtatttactgggtggaatacaaaactaatgtatgtgtatgtagtttatttatattgtaattttttattctgtataatagaggcatattctgttattaaggaagtaacttgtgctttctgtgccttgattttctcatctgtaaaatggaagtaattctgttactttatagggttgttatggtgattctaggaattaatgtatgtaaagtacttaacacacactggataataagcttgctgtcatcatcaccatcattgctgttactattatctaaaagcagctcacgtcctgaaatctacagtgagaagaatattcactgggctacgtaaacaaaatatacatgctcatctatatagttctttgatataatcatttttattctatataatacaagaagttcaatttttgagtcaaaatggcaatgggaagtctaaattaattcaacacacaaacgaggctgtgattgtttgttttactagagatttattagctttatcaaagtatcgtgtaggaagtagtaaagcgtattcttagatcacagcgcatttgagatgtggttgggtttatggacctgcggcgtgcacagacttgtctgggaggtgcacattcggtgacatgcacctgctctgtgctgtttcctggaagaggagaaggtgcgcccctcccactgattaggcaggcatccttgtgtgggggattaaggagcatattcagttattagctgtgaaatgtcgtggctgcctctgcattgccagctgtgattggtgctggattttaattatcatcaagcaagttccaaatgtttgaaatgtgtctgtggagagagctttggtggagagtgggagaaaaggtcttgatgaaggagcaaaaccttggcatcagccgtgcacacggccctgggatctttgccagctccccaccactgctgctgcagggtttcttgttgaccctaggggctagccccttccattatagaataacaacagttgtcagaaagccatttctcatatttacccaacattcacttttctatagatcctaaaggccctggtattttctcaggtgcaatgcagatgattcttcattcattcatccatgtgcacctctttgtctgtttgttccttgttcaataaatattatgtcaatgcctgctgatatggtttggctgtgtccccacccaaatctcattttgaaatgtaataatccccatgtgtcaagggtggggccaggtggagataattgaatcatgggggcagtttccgccctactcttctcatgggagtgaataagtctcatgagatctgatggttttataaatgggaattctcctgcacaagctctcttgcctgctgccatgtaagatgtgtcttgctttcccctttgtctttcgtcatgaatgtgaactgtgagccaattgcacctctttcctgcccagcgtggtggctcatacctgtaatcccagcactttgggaggccgaggtgggtgaatcacctgaggtcaggagttcaagtccagtctgaccaacatagtgaaaccccctctctactaaaaatacaaaattagccaggtatggtgacacatgcctgtaatcccagctacttgggaggctggggcaggagaattacttgaacccaggtggtggaggttgtagtgagcctagatcacgtcactgcattccagcctgggcaacaagagcgaaactccatctcaagaagaaaaaaaaaaaacagaaaaacaaacagaaaaagtctttcctttataataattacccagtcccaggtatgtctttattagcggcatgagaacagactaatacacctactgtgtgctggctgaggttctcaacgttgtgctgggcaccagggaatataaaacagtaagactcagtctctcctcttgaggagctcagaatggatgtggccggggaatgacaaaatgctatgatgtacaaatgtgaacaattagaatttgtacaaagaaaggaagtttggattaatgctgtcagagtgcaagagcttggggattcttcatggaaaagatgatgccagagaagagctttgaagaaggaaaagggtgttttctaggcaaactcaagtggagttgaattaggagagaagtgcgaagacatgacggatggatggaatgacacaggccaaagaatggagttaggaacgatgtgctgtgcttgggagctgcaagttctgctgacgggtggagagtaaggccaggtgtgagaggaaacaagccagatgggggagcgggatggtcacataggctttgaatgctgtgatgggaagtttagactttacctggcaagaggtagacaaccaccaaatgcttggcaacaaggttctatttgcattttagaaaggccactctggctgcagtgtggatgataagtcagtggatacaagattaaaggcagggagactagtcaagaagttactgtggtcaggaacagtagctcatgcctgtcaccccagcactttgggaggctgagataggagggtttattgaggccaggagttcgagaccggcatgggcaacatagtgagtcctcatctccagaaaaaaaaaaaaaaaaaaaaattagccaggtgtgttgctgtgcacctgtagtcccagctacttgggaggctgaggagggaggattgcctgagcccaggagtttgaggatgcagtgagccaggattgtgccattgcactgcagtctgggtgacagagcaagatcctatctcaaaaaataaaattaaaaagatgctactgcaatggtctaggtggggaaaggcaggtgattgcactaagttaggggtaatgggtttaggagaagcaggtggtttgaataaagttaggagggagaatagaggatcctatggctgtggatgtggtgcaaagagtcaagaaggatacctgcttctagcataggtgaggcaggtggatggcaacagaggaaatatggaaagaaaagtctttccacaagccctggaagagggagggaaaaggagcgttttggtggcatgcagtgacggtccagcccactacctaagcccaggaagcgtcacgtggtacttctcaacaggcagaccaggtatctgagtaaatgtctgctcagttggcaggtgtcagagaaatctacaagcagataaaacaggggctccgagggtgtaaatggtgggatttgaaggaaggtgagtacaaagatgatgctgggggtaagtgtgagatgtgaatggcatgaggtcttggcaggtattacaaggacttgggcacttagtctgaatatgatgggaagccagccatcacaggattttgaacttccaatggggtgctcctgtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgtagcctctaactcctgagttcaacggaacctcctgccacagcctcccaagaagatgagactataggtgcataccatcaggccttacctatttttgctttttaaattttttgtaaagatgggggtctgactagttttctaggctggtcttgaattcctgactttaagcagtcctcccacctgggcttcccaaagtgctaggattatacgtatgagccacgttgctcaccctgaaagtgctcagaaacatgcttcaggcataggtagtatttaacaaatttgctattatcgtttacattattttacctgaagcttgtatctcaaaatcttcaataagaataatatttaatgaggccgggcacagtggctcatgcctgtaataccagcactttgggagggcaaggcgggcggatcacctgaggtcaggagttcaagaccagcctggccaacagggtgtaacctcatctttactaaaaatacaaaaaaaaaaaaaaatgagcggggtgtggtggcggatacctgtaatcccagcttctggggaggctgaggcacaagaattgcctgaacccaggaggcggaggttgcagtgagccgagatcgcagcactgcattccaggctgagtaacagattgagaccctgtctcaagaaaaataataataggctgggtgcaatggcttatgtctgtaatcccagcactttagaaggcaaaggtgggcaggtcacgaggtcgggagttcgagaccagtctgactgatgtggtgaaaccccatctctaataaaaatacaaaacttagctgggcgtggtggtgcatgcctgtaatcccagctactgaggaggctgaggcaggagaattgcttgaatctgggaggtggatgttgcactgagccgagattgcaccactgcactccagcctgggctacagagtgagactccatctcaataataaaaataatgataacaataacaatatttaatgaaataatcatgctgtcttacttgtgagatgccatccttcgggctgttgatttgggaacagagagaaagtcaggggagaaagtcaggagctcagatggaagccattgcagcagttcaggtgggagttgatgctgccttggccccacatggggctatggatacagtgaaaagcagtcaggtgttgtgtaggtatagctgatgggagtttttggcatagcaaatgagaagtcatagagaaagacaagagtcagaaatgagaagcagagaaggtttgcttcatttcagcattatgttctgttggatgagcaacttttaaaaatggagccactatttcagttatcacttccaccagacactgtagagcctctgtcttgaagcccctgacctgcccctgggtgtagcccatcacctttctcatgggactcagacatgaatgcaagtgtggggccagaggccagcctaggagtgagatagactcgctattctcagaatttcccattcctctgtatttcatagtttctcattggtgctgtaacaaattaccacaaattcagtggcttaaagcaagaaccttatgaacgtattatcctcgggttctagagatcagatgtctggaaagagttttagggggataaaatccaggtgttagcagggctcagtttcttccggaggctccagggaagaatctgttttcttgctttttcctgtttctggggactgccactttccttggctcatggtcccttcctccacccttcaaagcacatcactccaacctctgctccatcatcacacctccttttcctctagctccaacctcttttcatttttcttttttttttttttttttgagatgggggtctcactctgtttcccatactggaatatagtggcaccatctctgctcaccgtaacctccacctcccgggttcaagcaatttccatgcctcatcctcccaagtagctgggattacaggcatgcaccaccaaacctggctaatttatgtatttttcatagagatggggcttcaccatgttggtcaggctggtcttgaactcctgacctcaggttatccacccactttggcctccgaaaatcttgaggttacgggtgtgagccaccgtgcctggtcacttctaagggcacttgtgataacataagacacacctgggttatccggaataatctccccagctcaatatccctaattacataacatctgcaaagtccatttggctatgtaaggtaacacattcagaggttctggagatgaggacatggacgtctttgagaaaggccttattcctcctacatctccaatggccaaggcttccttactggcatgggttccttccccagcttcctcttctcgatggccatgaaggctcctcagccttcctgcaaataggcccatcccacagtttttcccccgtgcctgactctcccttagtcttgagctgaaagccctcatttgtgaactgtgtattcatttaactcgattagctcatgtatgtaatgcacgtcgcatagtgcctggcacataggaagcaacttctaaaatagaattcagtctataaatataattttgaatcatggttctgtcactctgcttccaagctgactatgggtctgcaccatctgtaaatatgataaacacatcttctcaggtcatcctttccatcattgataaaaatgtccaactagacagagaactctgacattgctaacagcctataatctgtttataagtattttatatattttttagagaatgaccacctgcatttccaatgtattcttctcttccaatgatttgtacctcatgatccttcatttggcatttactgagttattactatgtgctaggcaccccaggaggttaaatgataaatgacaaacatgaggccagcttccaaggagcttgtgaatcatgctggaagatatgtacatatacgtgcacagctgttccatttattaacattctttggataaattgatggatcagccctgagtctaagctccagcccacattcctcattaattccattaatactgcaatacactcaatctatagcattagtcagtcgaagtgtctaggacctcaaaggaatggaagaggatttgcttgccatcactttttcgtagtgaacgcatgttaccactgaaggatcacctttactcattcagagtggtttcaaggcaccaattagcaaactgttgtgtaacagatgttttgtgtcattgctagcactcattttgttattgttgttattgttgttgttttttgttttgtttttgtttttgagacagtgtctcattctgtcgcccaggctggagggcagtagtgtgatctcggctcactgcagcctctgcctcccgcattaaagtgattctcctgcctcagcctcccgagtagctgggactataggcatgccatcacacccagctaatttttgtatttctttttcattagaggtggggtttccccatgttggccaggctcgccttgaactccttaccttcggtgatccacttgccttgtcctctgaaagttctgggattacaggtgtgagccaccatgcctggccagtattcgttttatatagcatctacccccagcaagatttatagacactggggcatttacccatttccaagtggtttgccttctcttcagttacctataatcactgcatctaattctgaaatcataatgtttgcaagattttatggcacctgggacacaattgattggggtctagattgttcattttaatcaaagtaggagctggtgcctatgtggtagtcaaacagtagatggacttatctcacatgtgccattcatcaaattccaatgttccatacatttatgaatgatctgtgacacacaccatgacttctgttgcatcgttttcccaccacgaacttcacttagcatgtgatggtttttcattcttctctttgttgtttggaggtcattctcttggggcaaaagttaaaagtcaagttagaaatggttaaaatctgcattttcaacacattggagaaaaactctggctcctggaaacagaatgaggaaagcatgaaaatgtggtgaatactttaaaaaagaaatatgcattttctcttctggttaaaaagataaatgcagctcaatacagttaagtaaatgttatacctgctttaagggtgatattgaccatgggaatgcaagagctacccgaattaaaaatggctgttggaatggtaatgcagtatcttgaattaccagtgaaattacttttcctcctcttaatgccttttctctgttagtatattttataccaccaatagccataagcacataaatacctggaagattcagtcctgtcctgtgctaggctcttgctcagaaaacaggtatttaattcccttatacatgatacagaccaaattgcagttgttgtaaaacatgctgtgaacaattttgacagtatcctgcctggtttttcttcacttttttttttttttttttttgccttaaaaagttttatttcacatataggtccaagttgaaatattattttttctggggggaaaaattaccaccccaagcccagtttcttctcaacacttactgtctttataattaattaatttgttgatgatttttctgtcaataccccaatggactgtaagttacataaggaaagccatgataatttgtatccccaaaccaaacacagtttccgagatgtagtagtaactcagtgattatttgttggatgaatgaaaatagacacaaaatggtacacgtatattgaataaattagggttatggaaaaggtcacatttctttaggaagtttgtagaggtggtgacatttaagcaaactgataacatagggggatttattataaattttctctccagtcgatgggcatagacatacttcatcccttgcaggcccagaatccgagatgtctatttttgacttgctatatatagagagaagaaacagtccctctgaatgtgaagttactcagtatttttggctctttggctattttcaaggttcttcatctggacttaaaaaccaaattaataggcgatcgtttcctcccatcttttgcacagacactattttaggagaagaagatctatcacccacagcatgtcagtgaacgaaggggctgtttttactgttcaatcaggaatgagcgtccacagcatcgttgctcacatactccagtaattccctactgacctgcatttactttatttaattccattaatttaagctaaatgaattttatttttaaaatgtgtctgtgcagaactaagcacagagagcatatttctgtttaactccttttgtttgcagcttgaaaaccaatttggatcttttattttcttttcccttggttctaagctttgcttggtcagtgtcttcagcacctaatttgacaattaaatgtatttcacaacccactgacactgcttcattaggttctccaggagtcatcatttccctgcagcctcattccagtcatttctaatagatggtgtgtgtattagtccattgctacactgctatgaagaactacctgagactgtgtaatttataaagaaaagaggtttaattgactcagagtttcacaggctgtataggaggcatggctgggaggcctcaggaaacttacaatcatggtggaatggcgaaggggaagcaagcacatcttcacatggtggcaggagagagagtgaagagggaagttttacagacttttaaataaccagacctcgtgagaactcattcattatcaggagaacagcatgggggaaatctgcacccatcattcagtcacgtcccaccagctccctcctccaacattaagagttataattcaacatgtgatttgggtggggacacagagccaaaccatatcagcatgccaatgaggctcttctgatgggacaaggaaactgccaggctcctcttggtcttgactcttgtgccaggaaagagtagctggatttcatcccaatgccgttcaccctggggaatacctgggttaagagagtttgtatttctactgatgtctcatcaaagaccttgctatttatgctgtccatatcggtgtcttttgtaaaccgaagttggaaagaaatgtttaaaaagaccgtacaatgtaataattactaattacttgatagccagcacttaataaatgcctgacgctgtgctctgtgcctcacaggtattaactaaattgtatcctgagagaaacctgtgaaaggtgtactgttgtttctatgttaaagatgaggagagtgaggcttaaggagagtaagtaatctggccaggccacttacctaagaagtggtggagttggactcacacccaaatagtctgatctccaaactttgcttgaccacatcctgtagcctcttggtttcatggcatagggctggatgctgtgtgctttgctagtcaattttagtaaagactttagacattgtttggtagtggactgggatcctcaggagttaatcacttttactgtttttaagttaccccgggatttatcaaataaatcgaattacttacagttcttcctctagctataacttatttgaaccctctgagttggggttggcgttgtttggtcacagatgaggagggcaaagtcaagaggcagatgttcgggctttccatagacatttcctgagcctgtataagagcctcaccatgcatataagcaatgcagtggttactgagacatgcataatgctactaggacattatgcatgataagtgttttttctgtgtgtgctcaccactgtacctgagtattcttaacattgtgcatggtactttgttagttatctgcaatatcatatgtgctgaattttgcaactcataatatggacagttgatgatttagtgtatgacatcttccttttgcattgtcactgctagtggcttgaagttctgcacccttagaatagcctggttttctgtgggtgtgagagatgtcctggaaactgaccccagttgaaaatcaatctagcctgtttttgtaggacaactctgttgtgaaaacctatgcactcaagggcagctggatcccacttgagcatgccgatggccccttgcagtttgaagtttgtgttgtcatgaggtcagttgcatacaggcagtgatgatgagactacaggacaggcagggcagatagcacatccttcggcctctgatgaaagatgcaaatggaaactgcagtcaggaaggtataatcaaacaccatccacccatgttaatgcagattgtcaggacggccaacctctcctttccccaggagtgtcacaggcatgattaacgtgctctgagttcagcagaaaccactgtggctcttaccccgggctgtgccttagctcaggcctaggtgaaatgcctgggcaagtgatgggattgtcgaggaatgtggaacatcccctgcttcccttctgcccctttcctcatgcctcctgagctgccccagtcatccaacctgcagtttgggtacagggaagtgttgactggagttcagtgcaatatacccttcctgatttcttgacaaattgtttccccgaaccactattctctcctgtgtggctcagaactacttctagttgctaagcaacccacaagcagctgtagcccacaatatcttctagaggggtagacatattatttgggatacttctccagtctcatctttccctgggagatgtcccttcccaagctctggccttccacattacaaacacacctgaatgaaccaaggtgagcatccgacccagggatgcagctcagatgggatgcagaaagctgggccaatttgatatcctctttaaaatttcaatgaaaatgcaaaaacaatactcagaaggtcttaaactgaaatactgtgtagacttgggacttaggtggccattagtcttactctgtcacccaggctggagtgcctcagctcactgcaacttccttctcctgggttcaagcaatcctcctgcctcagcctcctgagtagctgggactacaggcatgcaccaccatgcctggctaatttttgtatttttagtagagacggggcttcaccatgttggccaggctggtcttgaactcttgacctcgtgattcgtccgcctcagcctcccaaagtgctgggattacaggcgtgagccttaggtggccatttctaaatatacatgtattgatgagtaagcagagaaaggtgtggtacatggcatgaaataggatattgaagagaaaataaagaagatggggcctgtgggatgggagaagatggagagagtagtactcatctatgtctgcaaggtagctgggcttaaccaagcttataatttgtccaggggaatctgggtacctgccaggaggtggtttctgttctggcctatggtatttaggctgagaaattaggaaagagactatatgacaagggtagtaaagactaaaaggattggccgggtgcagtggcacatgcctgtaatcccagcaatctgggaggctgaggcaggcggatcacgaggtcaaagagatcaagatcatcctggccaatacggtgaaaacctgtctttactaaaagtacaaaaattagctgggtgtggtactgggcatctgtagtcccaactacttgggaggctgaggcaggagaatcgcttgaacttgggaggcagaggtttcaatgagccgagatcgtgccagtgtgcctcagcctgggtgacagagcgagacaccatctggaaaaaaaaaaaaaaaaaaatcagtaataggatcaagagggtggtgatatcgaatgagtccagtcaagtgcaacagtgaacagtatggatgagctgggagaatagaaggcaatgctctaagaatggatgcttgatattcagagctggagagagggtctaggctgcgtctgtggagtgtatggctgaggtggagttggaagcaaacatgattggagtcagtgatgagaaagacaagggagaccaggatgttgagtgcaccgtccaagagtgatgaccagagtcatggcggacggagaggcagtgagcccagtgccgttgctctcattgaggaggatgagggaacatgccctggggggtggtgagtggatggcagctgtatgagggatggggctaataatgtctaatgccgctgatctcaagtgagccagggttctaagggaggcaggtgaagagagagttgtaagtatctctggggaacaaataggacccagacatcctaagggaacgagctctctcctgtgtacatagcttcccctaaagtcctctgctagattctttctctctgactgcttgtcagcttcgttttattttcttgtttttttgttttgttttgttttgttttttcttttttttgagacggagttttgctcttgttgcccaggctggagtgcagtggggcaatctcggcccactgcaacctctgcctccaggattcaagcaattctcctgcctcagcctcccaagtagttgggattacaggcgtgtgccaccgtgcccagctaatcttttgtaattttagtacagacggggtttcgccatgtcatctaggctgatcttgaactcctcacctcaggtgatccacccactttggcctctcaaagtgctcggattacaggtgtgagccacctcgtgcagtcagcttcattttctcttatttctgactgtctgtcttcacgtagccaggatatagcccatgttttacgtctcacagctttagcccttgaagagagatggactaaacactctctgtctcatcccaagtctggggaagacagtccttctctattgaattggatgcttatctctgactcaggcagcagtggtcagcgtggcgggagggtcttcctaatttgctattaggatgaattcctagcaagatattatggaatgacaattccacatgcctgtgagagtcactttctaaagattgctctgaggaattcataggctttgtttccaagcttttaattcttccaagcccttaactctcagtatctaacaaccttccctcacaggctgccgggtgatagaaagggtcattgacgtccagcccttcagcagccagtgagaatagcaggggacagagcttgacttagtggtagcttctcagaaaaattcctgggtgggactttggtgcttaaagggggacacatccactcgaatgtttgtctttctggttagaaataaacactgttggccgtgcacggtggctcacacctgtaatcccagcactttgggaggccaaggtgggtggatcacgaggtcaagagattgagaccatccagaccaacatggtgaaaatcctgtctctactgaaaatacaaaaattagctgggcatggtggcacgcgcctgtaatcccagctactcaggaggctgaggcaggagaatcgcttgagcctgggaagcggaggttgcagtgagctgagatcacaccactgcactccagcctgggagaaagcaagcctcagaaaataaaaaaaaaagaaaagaaaaaaaaagaaacagtgttcctctgctgtcttccttctcgtaaattaaaactgcctaacacaccttctcttcaggtatgcagaagtcgccagaaacaagtgttttgtgatatcagtctccctgtcttttctctttgtaattcccaacaattgaggctgtatttctaggaagtgctttgaaagacagcgtccccttctcttgtcctgccgtcattggtcaaaacattttggggaattgcaagggagtagtcagattcatcttttaacagaagaatatgaaaaccttggaatatgatatcagtttggtgcaaaaatgattgtgtgtttgccatgcgaaagtaaccgcaattacttttgcaccaacttaataaaaatgtatctttctgagtcccaccctgagacattctgatgtgaaagtgagtaccaggaatctgtacttggagccagggtctggaaattcagcaggacccactttggaaatattgctttaatactttattagaatggaacttggaaaacagttcccagcccccagttttccctgaacacctactgcctgtttttcacataggcctgggtgagctattgtatcccttccatgtatatgaaggaagcatattcctttccggctgaatcttggccatctcaaaggtgtgaagatttctttcctcccttgttttcctccctttcttcctgtaggattcctgcgtgctatctctcacgttcattctcttttccctactactacaagcaaagcaaacacaaagtaaactaaaatgccccttgttttataaaaatatttcttctgttgctcattttcccatcccccccatcctggccaagcatgccttgtttaggaggttttgcattgttttgatttctccttgtgaagcatttatccccagaaactctctagtacacaaggaccttcctgaaaatctctcaaggatgtgagcaggagccttaacaatacttgaaaatacccagtgtgctctgtaacttctctcccactggtaaacgatgtcctcacaagctcattgatgagagtctctaagatgtacttgttaccaaggatgcaattttaatcagtgatttataaaactgaaatgatagagaaaaatgctctttcatttactaagtcattctttaatttgttcatccagccatctttccatctgtccatctacccatctacccatctacccacaatctacctgccagcctacctatccatttacccatctctccatctagctatccattcatccatgcacccatccatccatccatccatccatccctccatccatgcactcattcaattaacatttattgaatccccatttatgttctacagtagagccaaaagtgatgatttgaacagtgttagtactcaggaaggccactgtcttggtgatagggatatataaatatatatgtgtatatgaacagatattgtataatgtagtggccctaagcacagagtcactgatattcacaaagcataatgtgaaatgaggaagttattcttgtcacgcactgcatcctcatcgattgctgtcctgttgtgaaccacggttgaagtcaggtgtgtttctttacttggttttgtcagtgtgcactgggcaggttgtaaataccacaagagcaggaacagtgtctgcttaattgaatatgctctccccaggacccggcacaatgcctggcacatggtggacgcccaagggctccaaaagccaatgttccaagcagaaggtttgacatggtttggctgtgaccccacccaaatctcatcttgaattgtaacttccacaattcctacgggtcatgggagggaacccgtgggagggaattgaatcatgggagtgggtctttctcatgctgttcttgtgataatgaataagtctcatgagatctgatggttttataaagagaagtttccctgcacaagctctctctctttgcctgctgccatccatgtaagacgtgacttattcctctttgccttctgccatgattgtgaggcctccccagccatgtggaactgtaagtccattaaaccttttttttttcctagtcttgggtatgtctttatcagcagggttaaaatggactaatacaaggcacaataagaagaaaaggccaaagaggccaaaatgcagagtctgtgtggctgaggagagaaagaaaggtatagggaggcaggggaggaaccaaaactgcttttgttagtgggtaaaatgcagagatgaccttctgaagggctggggcttggttctgtgtgagaacagggagtcacacacaggtttgaagcagaaaaatggaacggccaggttttcgttttctatgggttcctctgaaggctgagtggagaatggatttgagggagagtaaaactgatggaggggagggtggcagaagtcaggaagctgttttaagtattccaggcaggagatgatgagaccctgttgaggtggaaacagagaggagagatgtgtgggaggcattcatggcccaggcagaaggagagtaatgcagaatgacttctagatgttagacttgggatgatgggaggatgcaagtggatcagcagggaacatgagaataagagagaacagactgcagaaataataagtttagcctgagattttcttccttttttttatatatataattttttattatactttaagttgtagggtacatgtgctcaacgtgcaggtttgttacatatgtatacatgtgccatgaagattttcttttagagacttttgagaatatcacagggagacatctggtcaactattgcctttatgcatctaaagctcagagaaaaactctctcagttgaggttattgcgttgagatcaacaatgtggtgtggtttaactcatgattatagtcagttcctgcaaagagctggtatagaatgagacaagccaaggataaagtgggaaccagggaagcttattaaccttgcctctgaactccttttttttttttttttttttttgagatggagtttttttttgagatggagccttactctgttgccaggatggcatgcagtgggacaatctgggctcacagcaacctccaccccctgggttcaagcgattctcctgcctcagcctcccgagtagctgggactacaggcacacaccaccatgcccagttaatttttgtatttttagttgcgacagggtttcaccattttggccaggatggtctcgatttcctgacctcgtgatctgccctcctcagcctcccaaagtgctgggattactggcgtgagccactgcgcccggccatctctgaactctttaaaggtgaggctcatttgattcagcatccctgttaactatacacagagtaggtcctttcacttttttaaatttttttttattttttagggatagggtctctgtttgtcattcagactggagcgcactggcgtgattatagctcacttcagccttcaacttctgggctcaagcaatcctcccacctcaacctctcaagtagccaggaatacatgcacgtgccacctaatgtttaaattaatttaaaaactgattttaatttttaagcctagttaattttcaaattattcattagagccagggtcttgtcatgttgcccaggctggtctagaacttctgggcccaagcagtcctcctgcttagcttcccaaagtgctgggatgacaggcgtgagccaccacacctggccagtaggtgcttttaaaaatattattggtttctggagtattggtcaaaagttttaagattcccattgcatcttcaaaaggtagagaatttggtttaaatcacttcattgttttcggaaaaatatagattttaaacttaaaaaaatttctcatgtaagggacattcaagtaacatagaagggaccaggagtttggagtatgttatttatttactcaatatatatgtatcaatgccttctgtattcaagtgatgaatgtgggaccctagggggcagtgctggctaggaattatggccaatgacttaaacaattacttacagatccttggtttcttcatctgtaaaatgggaataagaacatctactttttaggattactattctaattaatttaagttaatatagattaaatagagttagttatatttactataaatgttattctaaatcattttatttatttagtgtctgcattataataagggctgaaagaaaaccaaagagagaggtgtcctgatgcaattatgattacattacctttgcttgtcagccacatagcgctctttttactgagacctaaaagtgtttggatttcccaaaccattgccaaactggtaggtgaggagcctctgtctagcatactaataagctaaggtttgtgttttgcctgtacttttcattttccaggaatgaaaaatacattttcactctttgtcattttaatgaaatcaagtctagggaaacatgaaacgcaagtcacattccttttcaacgggaaaacttcgaaaaccgcacaccagattgcgaactgttaaaattcattcattaaaagttcatggtctattggactttttttccttcaagcgttgcattatgtacatttcctatctgtgtttgtgtgacagattgtctaacagatttcttgtacagtggagttacagagtctgccagaaaggcctagtttggaacctgtggccatcggtgaaagggatttggaaatgccatcttgttagctaccggataatttagtaatcatggcctaacagatccctcaagaccaacaattacatacctgtttgaagctaattggactatacagaaatgggagttatatgaattatatgttataaaaatgaggtaggcgttaagtggactgatattacattctgaaacctagaatgactttcaatcattttagtgcacaggcttagagtagccaggatgcttggcggaggttgtctgtcatatcagagtgcctgtttttagaccgtgtgctaattctgtgtgtcgctatatgcatatgaatgcatactgtgtatctctacgtgcgcggacaaatcacatatttgtttacccttaaagtttgctgataacaagcgttaaaaattagaattcataatccagattttgaaagccgcctgtatgccacaccaaatgctgctgaagagttatgggaaggcttttatttttagcactcagtaaattaaaccttttattcatcattcccaaagaagagaacatccgttcttattaatttaaggaaggggaaagacagccgtccaatcggagtgaacctgtgtgttaggacttgttcaagggagtgacatcacacacgctgtcatccttacatcagttaattaattatctgtgttacaataacaagatatttcagacaagagtctctctctctctctcataataactttaagcatggtagttagagtgttgagttctggttgcaaagacatttcccttaattcaatgcattttctctgaataattcatgtttgttcgtttggtttttttataacatataactgatcagacatttttcttttttttcttttcttttctttctttttttttttttttttttttgagatggaatcctgctctgttgcccaggctggaatggagtggcgtgattttggctcactgcaatctccccctcctgggttcaagcaattctcctatcttagcctcccaagtagctgggattacaggtgtgtgccaccacacccagctaatttttttattttaatagaggcggggcttcaccatgttgaccaggctggtcttgaactcgtgaccttgtgatctgcccgccttggcctcccaaagtgctgggattacagacgtgagccactgcgcccaaccaggcatttttcaaccacagcagttttgacatttcgggctagatgaatttattttaggtatggacatttctgtgtatcacagaatgtttagcagcattcctagactttacctgcccatagcaccctgtgcagttgtgacaaccaaaaaatctctagatgtttctttttccccctaaatgtcacctggaggacaaaatcacccctgattgagaacccatgctgtctactcatgagactgtcatttaggatatcatcaactgaaaaaatgttaaaatgaaagtatatgtgcttcagttgtattcatcctgcagtatttttttgtgccttcagccaccttatcctattaaacattttccaaatgtaaggtacatatgtagccactatttttgtactggttctagacaatatattttattttgagttgagagatagcagccattttcagtcattttaaatttgattaagatttaatgagaagagaaaaaaggcatacattttcgtaaactaatttcagcagatgtgtggatgcttttatataaacctacattgaaaaagaaggtagcagttatcattaggacagaaagacataaagtcctatatttctgccattgtaagtatatgtacatcatacaggtctggaataaaaaaatgtaaagtgtttctatgacccttcgctaatcacagaggaccaaggaggagagaggaatggagactttggaacaggtcaagtgctgcacatagcataatatagcttccctagatggctctgtattaaaatctcagaattaagttattctgtcatcgactcattccgaaagaaatcatgcttgctcgtttctcatgtctacccttactgccttctgtggggcatccagatgtttcaaaggtctgaaatgtaacaattatgttgcaggaattgcagtggctttgtttcggggtagaacattccaggctgtgagtttctttggaaggcaggcttctgattaggtgttgccaaaggctctgcctaaacgtttgttttctgttgatggagtctaagagctgagtggttttattttcctagaaacagctgcttcctttcagttggctgaatcggaggatttattccccttttccactgcacacagagccttatgatgggcactgggatgtggaaggagtggtatcaaaggaaaagtcatcttgtctttcagtgtttagcgtcaacactggggtaaatctctaacgttgcattctggagtgctgtttaagagtgtttttattttctttgaattcaagcatactggaaagaaggggtacctggtggcccatattttattagcaacgtactgcagcctcccatcaggttcttgctaatgaaggtggcatggccccactgccccctgaatctgcaggaaagtggatatgagaggcagtattcaggaagattttgaaaaggatgttttcccttcatttctccagatgctgtaaaacttcatgctggatgatgccaggtcaggagagagctgtgtgcatggagtggattgcgttagttccctgctagaattgcttttattggattgcaatttggggtaatattaggagcccatctttaaggagatagtaagaaacaggcatgccttttgtgcctctttgaggaggtggtggggatatgtacatctcaggtcctctggcatggtgactataaatcctggcttccctgtgtttcagaacacctggatccaaatcccagctctgcttttttacctaagtattttttgactcctataagcatttgcttcctcatctataatatgagggaaataatagctcccacatcacgagttgtgaagctcccgataaagagagtgggttagtcacttacctgcactgaatgttcaaaaattgtcactatcctgcttgttacatgataaaacctccgtttgctccagccttaaggaataactgtgctaattttattggttatttattggtttattttcacaatataggtacctggaatggtggatatcaaccataagatttccttccatgccgattggtaggaaagccagcaggaaatgttggcctctacccagccaacatggagtgctttgaggtttgtgtgtgggtattaacttcattcctggcttcagtatgtttccaacccctgtttccatttctttacttttatcacctcttaacaagatagataaataaatctgttttatgctgctgtattgtgtttgtcaatatgaagcaaattaatcctttcttgacctgtggtggtggcaggggaataaattttatatatatatacatatatatatgtgtatatatatatatatatatatacatatatatatgtatatatatatatatacatatatatatatatatatgtgtatatatatatatatatatatatatatatatatatctcctctgaaatattgatcttctcttcttctttataacccctgaataacaggagccacaaactcaaacatctaagcagatagcatcaatgagaaaaatgggcccagtttaagacaatagggattagtgggtactgccataaatagacaggatattttccattctccaaccacacctccatatttcttcaccattgagtgtctcagttaccccgatgtccactcttcctttctcatcccatgtctttcaattcaacacagtattcttttgatccagtgcatgcttgtaaattttgctaaaactctacctattattcttttatttttttatttttgaagcaaaatagcatgttctgaggtagcctagaaatgtgtctgacacaaagcattctgtggggttagaagaacaactaataattatggaagtatcaacattaggaatagtggttgctgacatttattagtacttgctatgttctgcttaactatgttgcatgctttagatgatttttttgactttcaaccccaggagttaggtaatcttcttatctccattgttatcactaggaatatggagatgcaaggagacagagagactcactcgggccaaaatccagttgctcaacacttccacctgtcagcctcctgggcgtgacttccccaacgtggggaagatctgatgtgtgttttgtaggtattaccaccttcacctggaaataattcaccactctctaacttagatacttcctggtcatctttcgagactcagctctgggctatcaccagccttagaagccttcccttaccaccctttactggggcaggtgtcccctcctgtgtttcttggctcacaccaccacagacagagcacatacagtattatgagcaacttttggccctgtgctgctcttcctcccgtgactccatccatgactccttcctcccatgactccatccatggctctttccttccatggttccatccatggctccttccttccatgactccatccatggccactccctcccatgactccatccatggccccttccttccatgacccctccctcccatgagtccacccatggctctccttccttccatgactctatccatggttccatccatggctccttccttccatgactccatccatggctccttccttccatggctccatccatggatccttccttccatgactccatccatggctccttccttccatggctccatccatggctccttccttccatgactccatccatgggtccttccttccacggctccatccatggatccttccttccatgactccacccatggcttcttccttccatgactccacccatggctccttccttccatgactccatccatgactccatccatggctccttccttccatgactccatccatggctgcatcctttcatgactctatccatggtcccttccttccatggctccatccatggctccttccttccctggctctcttctttccatgtctcttttccttccataactctcttccttccacgtctctcttcctgccatgactccatccatggccccttccttccatggctccatccttccatgactccagtgccatattttgtaggcaaaaactcatggagagaaaaagaccctctgagaagcatctaccagggatgtacctagagatcgtcaagtgatacctgaacaataggggccacaaactcaactatctaagcaaatagcatcaatgagaaaaatgggcccagtttaagacaatagggattgatgggagctgccataaatagacatgatatttgactataggtggttcacagtttagcctttgcagttagactgctttaaagtggatccttgtgccttatttcactagctatgtgacctgggttaataatgagtctctctgtgtctcagttgccacatccacaaaatgaggaaaataattatgcctaccctaggggggtcctgagtagatataagatggtgttcataaagcccttagcacacagctttgcacctagaaggtgctcattaaattagttcctgttctccatgcttagtataacttctgtatgatgttcagcgttgctttggggcaacactgcaggcaattaaattgtctttctttaattgtcatttcttcctcttattccacaggtatgtattgtacaactactctaaagtggggcacaaaatagacaaagcccctgactttctttttttaattattatcatccttttaacttctgggatacatgtacagaacgtgcaagttcgttacataggtatacacatgccacagtggtttgctgcacccatcaacctgtcatctacattaggtatttgtcctaatgccatccctcctctagccccccaccccttgacaggccccggtgtgtgatgttccccttcctgtgtccatgtgttttcattattcaactcgtatttatgagtgaaaacatgcggtgtttggttttctgttcctgtgttagtttgctgagaatgatggtctacgcaaataaactagaaaatctacaagaaatggataaattcctggacacatacaccctcccaagactaaaccaggaagaagccgaatcccttaatagaccaataacaagttctgaaattgaggcagtaattaatagcctaccaaccaaaaaaaagcccaggaccagacggattcacagtagaattctaccagaggtgcgaagaggagctggtactgttccttctgaaactatttccaaacaatagaaaaagagggactcctccgtaactcattttatggaagcccctgactttctaagcttattggtttcactggtgttgtctgtaatggcagccatgagccccatgtgactgtttaaatttaaatgtaaaaattcagtgcctcactgggactagttacatttcaagtgcttactgaccacacagggccagaggctaccatactggatggcacggatatgtgagtttgctgaagctgccatagtaaaatgccacagactgtttggcttaagcaatagaaacttaattgtctctcagttctggaggccgaagtccaaatccaaggcgttggcatggttggtttgttctgaggctttcctgcttggttggtagatggccgtcttctctctgggttttcacatggtctttctgtgtctgtgtctttgtctttgtctcctcttcttgcaaaggcagcagtcatgttggatgagggcccaccctatgacctcgttttaactcagtcacctctttaaagaccttctttccaaatacacattctgatgtacagggggttaaggcttcaatatatgaatttgggagtggggcaagtatgccattcagcacatcacaacaggatagaaaatttttataattacagatggtggctcattcctgcaactgtagcactttgggaggtcaaggcaggtgaatctcttaagcccaggagtttaagaccagcctgggcaacatagcagaaccatatctctactaaaaatacaaaaattagctgggtgtggtggtatgtgcctgtggtcccagctatttgggaggctgaggagggaggatcacctgagcctggggagatcaagactgtggtgagctgagattgctccactgcactgtaatttatgtgactgagtgagacaccttctcaaaaacaaggaaacaaaaaatgaaaacaaacaaaaaacaccttaaacaaataaatgtccgtgttatttactaatactgaatatatacttaaaaccagcacttcacctacatgtgcattcttctgcctgggaggtgttgatagagtgaccttaggaaaatgtctttgtctgtggttcaaaaatgaattggacttgagtgagaagaggcacacatcttctctccccctccctccccttgcttcttcccatttccatgttccgtcccctattattctctcatactctatttctcctcatatacaggtttttttttttttttttttttttttttttttttttttttttgagttggcgtctcgccctgtcacccaggctggagtacagcggcacatctcggctcactgcaacctctgcctcccaggttcatgccattctcctgcctcagcctcccaagtagctgggactataggcacccactaccatgcctggctaatttttttttttttttttgtatttttagtagagacggggtttcactgtgttagccaggatggtctcaatctcctgacctcaggatccacccgccctggcctcccaaagtgctgggattacaggcgtgagccgccacgcctggcctaccaggtgtttttctaggccctattttagaagaggaagaaaagatttttaccctcaaggaatcttcagtctactggtgtctgagagacctgaacaacctaaccacgatgtattgccaaagctggtgagacagaagcaggggaaaaatgaaacaggatcccttggaagggagatgtcactcctgctctgcggtcgtgggaaaggctgcagagagaaggcatttcctctacacccaaccttgaccttcagcaagtcccttagcctcccgttgagtggcaggcaacatgtaaacagcagctatctcttagagggcaggagttctatgaatgcacttattaatcactgtgaagctgatgaaaacgatcaccataaaactatgacacactccttttcttttccaagaccagtagtgctgaaaggccttcttgtccgaggcttaccatatagacaggtacctcatatcaccatgaatatatgacgactttttaatcaagtgttaatggtctcctacacttcacaaagcaggaatggagggggtcgttgcagctggtaatgaccgtatttgcttttattgtatgattacctttattcaatctctagttccaaaaagggttttagatggcttataataaaggtgcagattcaataaaccatgagattattaaaagaaattacgtggtgagcctagtaatgaaataattggggggtggtaagaaaatattcacagaaatcttaagatttcattttttccaattgattaagaatcttagactaaagctagccactggaactgagcacaaagcttatatctaaggattctgataaaatgcaaagaaaagaagaaagaaaaaaagaaacaaagattatatgtctttatatgtcgagctatattgctttcttctttcaacaataatttatttagcacctactctgttgctggggttttgatagatgctggggagtggagggagaaagatataaatactattaagaccaagtcctttcagatagaagaattatgtatttctgtaaaagagaattgtgtatttttagaaaagaacatggattagtgtgtgtgtatgtgtgtgcgtgtgtaagagtgtgcatctattcaagctttgtttttccccctagatatgggtgtctcaccctgtcttccaggctggagtgcattggcatggtcatagcttactgctgttctgaagttctgggctcaagcaatattcccatctcagcctctagagtggctgcgattattcaagtttatcattgatgattgggaagagccacagtcaatgaacctagagaccagataacttagggccctgttaaggcaagttaaggagtttagcttttactttaaggacaattgggaaccattgaagtggatcaaattttctatttagaaagataactctccctgcagtgtggagaatggattgcggtggaaggagagaggagaggaacatcagttagagggcggttgcaggctgatgggcactttgggtgggaataatggctatgggaatgaagacaactgaatggatccgtgagacacagagcaagataaactatttaacttgtagatcaattgtacatgaagaatgaagttatgagaggaagcaacgtggactcaagtttcattctggtaccttctagttggattcatgtaccatttaatgagatggcagaattagaaaaaagagaaagtattgggtcttagtgagaagatgatgtattaacttgtaggtatgatgtctgagatgtttggaagacacttaggagaagatagatgttaagtaggcagctgagtataagaatctcacactgagaagtgagaggggattggtgatttgggagccttggagtataaacaggttttaagccatgggaattgatggagtcctctaggtagagtttaaagaatgaaaagaaaagaaaatccaagacgtctttggaccccaaacattgagacgtttcccagaggagaaaggatttataagacagtctaagcaccagtagctagagatgtcagaaaatcagcaggaaatagtggtgttatggaagcaaaaggaaaactacgtattacagagcctgtgatggagtggccatagggtcccttgccaatggaagccatggcattggatgatagactcaagaagtactcagagtgagagaagatgagagcccaggacacatctctgggcccttgtgttattttctggtgactgtgaatttccggaagtccccccccccgcaatagctttgatttgacatggagagaagtgtgccttccatgatacactgtgaattactgactaccgttccaggcatcttaactataactttaatcatctgagctctagctcccatcaccattcctgcagtgccccaggactcattaaatcgccaggggtattcgaagacctcccaattaaggacccgttttatgagcatagttgaaatcctggaaattattgcctctttgaggcacaggagtaggtgctggtatctgctaggatgaatgataatgtggaccccggtgatttgctgtccttcatcgtttgatctgctttaatgaccagagagtaattagtccgttgttgtgtgcagctaggtgttacaaatggagttgtaaattcagcgccttggaataaaaagtggctattagtttctcccctgcaattcagtttacagatagttctggggcaaagtgagaagaagcccagtgtgccctttcaggggtgacatggtggtcacgtacatgtgcaaacagatgcgtgtgcacacacatacataggtttgtgttctcaaaactgaaaaaaaaaagaatctctttgatgtaatttctttgtagcatgtttttaaatgaagatattgaagctgatggcatccagggctggggaagtttgaagaagggaacagaaaattttgcaattggatttccagcagtaactgtgtgcaaacacggcccctccctgtatagcagaactctgtgttatcctgagctctggaagttcgtctgcagcatgaagttttttaccttgctggcatcactcaggaccacagagggagcatgcctgctggttaaggatctgtgggactacctgtgttctcagtctggctgtactatttactattggtttcaccttggaaaagacacttaatgcctctaaggcttcatttctccatctattaatgaagatagccgtagaaccagactcattgatttattagaagactcaaatgagaacattcacggaaagagcttgccatgacaccagagatataccaggtgctaaataagttgcttattattctcacatcttcatcacagtaaacaacttggagaatacagacaaaccaggcatcaaccattggtgtttcagagcaagagaataactgacatccagtatcgtttcctaagttgatcaaactcttcctgaccatgtggcgatatatgcagaggcccctcaaaccacagggaaaacaaggtaaagtggccagtgctatgctcatttgacctaggagtaaggaatgaaaaacggtatctgtgttaaagcaattacagatatacgacagagttgcatgtaaaatgcatgtggatttctaggacaaacacatcatatcaaatgcatcttgcccttgcaatacttgattccagttgtgtttcccagaattactggagggttaggtcactctcctctggggacagctgattttctccacaaaactggtgattaggaggactgtggaaatgtgcccacacttcccagtaagcatttcttcttgtgctttattgaagattccactagaaattaagtgctttggaaattgaagttttgaaatcagcacattttcagccaagcctggtggctcacgcctgtaatcccagcactttgggaggccaaggtgggtggatcccgaggtcagcagatcgagaccatcctggctaacacagtgaaaccccgtctctactaaaactacaaaaaaattagccggccatggtggcgggtgcctgtagtcccagctacttgggaggctgaggcaggagaatggcgtgaacccgggaggcagaggttgcagtgagccgagatggcgccactgcactccagcctgggcgacagagggcgaaatcagcaagttttctttattcaggatactcactcggcttaccatgccatcctttcaaaagagttttaattttatttctcctctctgcatcccctcagtatgaatttaggtacaccaagaatttatcaagcttcaaaataatctaaactatttgaaatggaagacacctaagaaagaaaatcgctttagagctgatcagtcactgacctctatatctcatctcaaagattttcttttaattaccctatatctcatgcttctgatatctttaaagattaataaggcatccatatatccaaacaatatagatatatggaatatagaaaataccaatgtctttagagtcaatacttaaaaaatcttgctcttgccgggcacagtggctcatgactgtaatcccagcactttgggaggctgaggtgggcggatcacctgagattgggagtttgagaccagcctggccaacatggagaaactgagaaaccctgtctctacataagatacaaaattagctggatgtggtggcgaatgcctgtaatcccagctacttgggaggctgaggcaggagaatagcttgaacctgagaggcggaggttgtggtgagctgagatagtgccattgcactccagcccgggcaacaagagtgaaactccatctcaaaaaaaaaaaaaaaaaaaaaaaaaaaaaaaaaaaaaaaaaaaattcttgctctttctcatgaatagctgcccaatattctgtaatgtaggttatattagattgcttggggctgccataatacagcattgcagacttggcagcttaagtaacagaagtttattttctcatagttctggaggctggacatccaagattaaggtgtcagcaggattggttccattggttctctctccttggcttgtacgtggccatcttttccctgtgtttttccctgtgtgtgtgactgtgtcctaatctcttcttataagaacactggtcatagtggacaacctataggatgagagaaaatttttgcaatctatccgtctgacaaaggtctaatatccagaatctacaaggaacttaaggaaatttacaagaaaaaaaacaccccatagaaaagtgggcaaaggctatgaacagacacttctcaaaaaaaaaacatacatgcggccaaacatatgagaaaaagctcaacatcagcgatcattagagagatgcaaatcaaaaccacaatgagataccatctcacaccagtcagaatggcgattattaaaaagttaagaaacaacagatgctggtgagcttgtagataaataggaacacttttacactgttagtgggaatgtaaattcattcaaccattgtggaagacagtgtggtgattccttaaaggtttagaaccaaaaataccatttgctgcagcaatcccattactgggtatatagccaaaggaatataaatcattctattataaagatacatgcacgtatatgttaatagaagcactattcagaataccaaaaaaaaaaaaaagtggaatcaacctaaatgcccatcaatgatagactggataaagaaaatgtaatacatgtacaccatggaatactatgcagccataaaaaggactgagatcatgtcctttgcaaggtcatggatgaaactggaagccattaccttagcaaactaaagcaagaacagaaaaccaaacactgcatgctctcacttataagtgggagctgaacaatgagaacagatagacacagagaggggaacaacactcactagagcctgttgggagagggtggggggaagaaagcattagggaaaagaatgaatgcatgctgggcttagtacctaggtgatgaggctgataggtgcagcagcccatcatggcacgcatttacctatgtagtgcacccacacatcctgcacatgtatcccagaacttaaaaaaattaattaaattttaaaaaaagaacactggtcatagtggattagagcctacccttatggattccttttaacttaattaactcgttaaagaccttatctccaaataagggcacattctgaggtttgagggattaagacttcaacgtatgaattttgagggctactatcagcccatgacttaggtgtatgtaatttatttaactatattcccatccatgatctttcaggctaattttacttgttttgtatttcttcacattaaacaatgtcatatcaactaatccaaccataacacttgtgtggctggataaaacagaaatgttttattgtgatgtggaattttaactttgtcttttttgttcaaactaagaatggcttatgtctccccatagggataacatgattttgttttgacagaaatctttaatggaagattattttttttctcagtggcaatctgcagattaatgggataattttaggtgaactgaagagaatggagggctgttctgtttaagctatctttgtgcttatgtagggacagtaatatcatccaataaaaggacatatgcaattatatcagctttgtggtaattatatggatattttcattgttcagtacatttaattatgctttgttaaacagcctgtattagcttttggtggggcaagctttgactggattaatgccaggggcttgtatgttgaatgtttcacacgatgcatctttctagaaggaaagagcaaacaaaaattaagaaaaagggtcatgattacctttcccttatttttccttttcaacaacatttttaatggacagttccagagacaatttcatcctttataaaatccttatattagtcatttgaaagaaaagcaactaatatatggttttggaaccgttaacccaacacagaactctttagagttaatgtgtggcctcctccccatctaccttcgcagtcctccagtctcactctgggaggggcagaatttccattgacagcctgatgcatgctcttctgtatggtcccctttgctgatacaattatccatgtgcatgcttatgctttttaaagggtggcctcatcctccgccttttattcagtaacttgccttttttgcaaggcatggttattgtccacacatgccaattattaaaaatctacttactccttttacatatctgcatagtattccatagtatggatgcgtcactatttgttcagccatccttccactgatgttctttagattaattcttcgttggatttgtgtatttttttcttctgccaaaataagcattgctataagaaacatttggcacgtatttctttcattttggtactttctgttggctaaaattctctgaaatgaaataattagtaaaagctcaccaattttttaatttcaacaaatattaccatgtttttaccccccaccgccccccacacacaaaattggagcaatttgaagtcttcccgacgctataaactacctgaacaacactggatgttagcaatcttttaaaaagtattgagtatacacatggcacattgttgctttaattttcatgttcttgacgactaattatacacaaaatctttcctcttataggaattatttaggtacaatatttgttcattttcaattagtttatctttttcttgttaatctattaattcttcgtatcttaaagctgttcaccttagcttgtgaaacttgtgataaacacatgctgtgatttaccttttgagtttatctacaagatcctagtccacttaaaagtactttgtgatcacttttattaataacttaaggagctatccttcccctattcaacttttataaaaacagcctcttgtaatactttatagttttttgctttatctttaggtgtttaaatttacctggaatttacttttgcaaagctaagtatgaaatctaacatgcattatttttcctgtaaagggtagtcagatggcctaatgacaacattaattccatattccaccctttctgttaactcggatgtgtgcatatactcacacagatcacaatttctgaactctattaactcaggtcaactatttatttgctgttgtgtattaaagagttttgcctactaatatattttagccttggcaggatgctatgagatgacatagtaacgataagaattccttactttaaaagttgggcaggtaacatttggggtcagaagctttttgaactgatgaactagttagatttgatggggggtcggggcggagtgtaagtggcagaaatctgacccaagctgatgcaagcaagaaggaagagtattgactttcagacaggaaaaccaagggttgctctaagcttactgaattcagaagctcaaccaatgtcgtgagcaccggtctcgttcaccatgtcatttagctctcttacagccatgtttagcttggctccgccattatacagcagaaagatgcttactaaccgccccaagtttcatcttattccctgaacagcaccagcaaagcacactgaatcacgtgcccatcactaaacaatccccactgttagaaggaggtgagttcctcactggctagactagctctcgcgcccaccatgacctaggaggtgtaatcaatcctgcaggaaccacccagcttgatagtttatcctcccagagaggaggagagccactaagaaaaaatcaaatgctgttaccagaaagaggggctgaccatttgataggctaaaactagtgaatttcactgttcctgattaatgtgaatcaaattttcatgttagttccgaaaattttatcccactgggatgaaggcaactttttcatcgaaatgtgggccacatttaattcctgcatgtaaatgttggtatccagagaaaaacaaattaagataacaatgagatgcgatctttacaacttgaattggcaaagattaacaagttgctaatagccattttggtactactgtgagtaaaacaaaaaaaatcatatattaatggttggagtgcaaactggaataatctttgaagagctgcttttacgaaaagatatacagcttttatcagcaatgcttttttaatgaattaactccatagcaaaaatattttcaattggtttgaaaatagctacgccaatacacaaaagtatgcttgtgaaagtcttggatgacagcaacaacaagcgttgtttgtaataacgaagtcctaccctgatctaatgcatactagtagtgagctgattataaaattgctgtctagttatgcatttgcctgacatttgaagaaaggacaattataccttttaaattaataccattgtttaaatgaaaagaaaacagctacttaatgaagatttagccctaacatcgctgctatagttaattcttcgcaatgattcaccctagagtggtcaggtcacctctcttgtgctttgattacaccttccatatggattacggatcatatgcaaaacatttaattactgagctacagcattaatcacttggctgaatgtatttcaccttttctccttcctgcaatgtttaagccaagttaactgatagcagtgcgttaaaaacaggtagtactatacagcagtaggagaatgtagcctccagcacagagatcccgggggcaattctggagctatcatttattagctctgttgccctcgggcaaatcacttactagctcaggtgagtctgtatcttcttttgtaacatggtcataataaacacagtttctcatatctagcctgattatcgtgaattgtccacacagtatatataagccctgaagccctggacacaaatgtgtaaacattgttcttatggaactgctgattattattattaatctccattttcttgtttctgtgcgatcaggtttttacccatgcaaagtggttgtctaagactatatagatgtgtagagagaggcagagtaggttatttggaaaaagaaagtggtggagtgaggttttgttgttgttattgttgttaattattttatttcatagggagaaggagggcactctccgtgtaccttcgtaaagaatagtacatactctttattttgacagtgtagggtaaacctgtaagagtcaagaaaataacagatttgatactaccctttagtggctatcttgcatgttaatgtatatcctttcatttctgtctgagttcagcagttagactcagctcgtgggttcctacagctcaatttctaaaatctacgtaagaagtaaaatgctgctaagtttacctgcacttttagtgtacattcagatcagagtcttctcagttatagatgtatagggctgtgtgtgtgtgtgtgtgtgtgtgtgtgtgtgtgtgtgtatttatgtccttaaattaagcgctattggagcatggccctgcatatttgtttctgtattgcctgtggtcatttttgtgctaaaagggaagaattgaggagttgcaacagagaccatgtggtccaaaatatttactatatggctctttgcaggacaaaagaaatgctaactgttgatttaggctacagtttactttaagtcactgttacatcaatgaaaaacttggaaactaaatacatttgtgtgtttgtgtgtgtgtgtgtgtgttctttaaacttttaagctaatccttagtttaaccaaaaagaaagactgggtgtcgtggctcatgcctgtaatcctagcatattgagaggctgaggtgggtggatcacttgaggtcacgagtttgagaccagcctggtcaacatggtgaaaccccatctctactaaaaatatgaaaattagccaggtgtggtggtgggcacctgtaatcccagctacttgggaggctgaggcagaagaatcgcttgaacccgggaggcagaggttgcaagtgagctgaggttgcaccactgcactccagcctgggcgacagattaaaactctatctcaaaaaaaaaaaaaaggattaaggattaaaaaaaattgaaatcatccatggttataatattcttgactgcatcttaacatcattggtttgtttttcaaatattgttaaatgcttactatattccagttatggtgcgaggtactttcccatatgttatttagttttagaatcctctcagccaccacctgaagtagttgctattaaacccattttagaggtgaggaaacagatgttcaggaggatttaaataacttgccacgtttcttgaaacttcccagagccagaattcaaccttagatatgtatgaattcaatctgatgcttgctgggttaagaccattggagacaccctctctcctctgtccttttgacaattccatgggcagaatatcacaggaatggcaaatagagggataaagaatgtatgtgacatgcacccaaagagtctccaggccccttttcatcctttcaatcatgtttctaaggtattttgaactaggcgaggctctcttagttcgaataatagcatgctgttcaatgtggacattaatagtcagaatctggtagtgcagctacagaagaagcaaagaaaaaaatgaaatcctctcattgatttctagtcagagaggtgcagaaaccctaagagtccttatgtgagaataagtgttttctctctgtgtcaatcttaatataactaaatgcagcagatttaatcctttctataatttaataatttgtattaattacacttaatgaaatataaattaattacatttaatgaaatataataaagtttatttaatatattaattacgtgtaatgtaacatatgggattttatttaatatactaaccatttaatgtaatataataaaatttacttaatatatgaattacagttagtgtaatataataaagtttacttaatatattagttacagttaatgtaatataaagtttacttaatatattaattgcagttaatgtaatataataaagttttcttaatatattaattacagttaatgtaatataaagcttacttaatccatatttaataaattgaattccattaatatgtattatgtgggttaacatacatacagtgttgtaacaacaccaggaccttagtttacattaaaatagtgcttatttttatagtattgttattttaataattatttatgttactgttaaataagttgacatatatttatgtccaggcaaggtgactttatagtagctgggttttccaaagtgccatatttatatcccctagaagtatactatgctgagacaggagttcttagctgtagaataaagagagctggttttgtagaacattaattttgctccaagcttttggaggaaaaatgttgtttcctattaaaaggaaacaaatatacaggaaatagacagctaatgtgcatgcagtttttaagagaaagcccgagactgcagtcatcctgtgtgatatgccactggactcttccatctatggctctggagcccctaagggtaaggattagacctcatctgccattagctagcggtacttaagtgggaaattttgcaaagcagtaaattataacactactcaaaagtggtttctatttttgtaatattatgatgtaaagttactgagtttgataatgcaatctacatccctttgttgaaactgtagaatatggccaataaagggttaatgggaaaatcccagaatctgctttctttttaatgtttctaatggtcatcttagcaccagagcctctttgagagttaagagaaagaaattaccagagaaggagagtctgtgtctcctgggagatggatggtttgggggaatacggagtggggatggtgatttttctctgcacagaaatactttcttgaagtcagccctttactgtgcaatgtgggatagaattctaacacctccagtataatggcaggaggaggaatggttaggaacattggagagctatttggcctatgtctctttgttatgaagggcccacagtttacgtttttgactttttcaccaaataaaggcttatagcaagttacccagatatgttggcagaatggcaaggctacattcatcatagaactttaagcttgtgccccactgctgggccatactgcctgtcaggcccaaattaatatcttttataagccccgcaacgatgttgtaaagaatacaattatagcttaggacattgccatctgtggtgggacatttcaaacagaattaagtctagagattatgagtgatgcatcattgtcactcaaactgaaattggtatagcaccttctgttttattcaaaattctaaagggaaattattctgccacaaaaattctcatctgttaagtagcccttaaatgactttttttttttgcctttgcaaaaacaaataaaaccattttatttgtgtgtgagttagaacattgaaatgttgagcctagatttttaaatgtgtcgtgatttttgcttctcttgctcagtcctcttttctacttctttctgccttttttatttctaattttattttattattttttagtcttttattttaagttcagtggtacatatgcaggtttgtaacataggtaaacttgtgtcatgggggttcattgtacagattatttcatcacccaggtattaagcctagtacctacccactagttatttttcttcatcctctccctccttccaccctccaccctcagatagggcccattgtgtgttgtttccctaccttttcttaggaaccagaagccccaggcattggaagtggtcaaggcatttttttctttgacccctgggaaggtcttttcttagtacacaagcaacaagaacttcagacagagagtatatgatgctgcattacaacctgaaccattggagttctgtcaaaagaatattgaagagatcctggtagaaaagaaaatagagtcaagaaaaaagaaagtgcagagtaaaatatagagaagtagagggaaaataatgtaatgctgccaaacctaataagagtactgaaattgttgcctctcacaagccagtgactttctcaagttacaaccaaggtatgggattcaaatgatcccactgacaatccctctggaaagtctccagttgaagcctaccctatcatttctttaagagacccacatagacaagttttctccaggtctgagctggatttccttcgttgattgagcaccagatgaggaattggcgtgattttaagggccacgtgcactatgcgaaaaagagttagctttgaaaacaagacaaatacggggtgagacgagatgcaaatgctcggaggtatctcagcactcaagaacaaatgcatgttcacatctcctgtgttaggcttgctcactgctttgatagccggtggaatcactggcaacgttcacattttttcctcctcctgttttcttacctcctcatgttttagttgaatgcatgtaacttgagtaagattaaaaagtgattctcagaatcggaactttgagcttcctgcaaaaggaatatttaagcatctctgtatccaagagtaccatcttatctcacgggctcactaagtgggagttaggaatcctacagttcccttcaagacctatagggcagtagatttgaaccttacaatcctatattgtatttcatgttgaccaatctgtaagcaggtaaagaactgccatcttactggtgataaagagtttatgatgttaactgagctctcattctagacaacaaagtaatccagtgtcctattcaaacttaattcatagttatcaaacagtcattaagtatctactttgtgcctgatagacatttctttaaccagaatgctttgccactgtatcctcattcatttaaaatagagtatatagaaaccagatttagatactgcctctagttgaaattcctgcatccaggtagggctggctgtttgtcttagagaatatgtccctttatgtcctgtctggataggtggaaggtgagtaggtttaacaagtaacatttgatccaggcatttttacagtaacagtttgttattgctggaatttgaccatctcaattcattttcgtaggtataaactagtcatggatattaaatgtgtgactatattgatatatgaaagcttactgatggcacagttttatcatcagtgcctttattcaaatgagttttaaaagttgattagcaactgcattctcctatgttggcttggacatgaatagtgcaaatatgtcagtctttctattcttccaagatgaccttcagctctctatgtgcatgaattccagttggcctttagccactcctccaagtagaacacatatctatccagttgcctcttgtgtaactctttctggagcttccatagcccctacccaacttgatgtggtcaaaatgagcctcttatctttcccaggtatttgtctgatgcccctgaacctggtcatcgataccaccatttagtcaataacttgtaacagtgatctaggagttggccttgactttttggcttcttttacacttgtttttatcctttttttaacacctccagttatacatgtcttctagtgtttctttcagtgagtcttgtcaattctatttatcaaatatttaccaaatcctcttttccattataccgttactgctgtgtctttgtgcaaaccctcatcatcttttaggctaagatacaataaaataatcttccagaggctcttcctgcttccagtgttcctttctgcacacacgagggtagccttcctagcaatgactgttccattttcttatagaggaattaaatctaaatttcttggcatgacacatgggcccctttatcatcttacctgtgccccctttccctgcctggtcttcagacatcaaccctttccatcagttcacccagtcacatctctgcacctttgcataagctgtttcctatggtttgaatgcctttctcccctgactatcgaacaacctgctatgcatccttggagatccaactcaagcatcatcaccttttgaattctctgaaagatgccctttgcctttagttagaacaagaggcatcctctaccaagtagatgcatagcacaatttattccattctgtcatctagtacgataattatactactagtttctattataatacttgtttgttattttccttctccagtaaacgtattctactttgcattctccaggcctaaaagagttctggaatgcaatgggcattcatgtaagtaatgttaaaagaatgactccatcaattatatttctgtgacattctcaggtaggaagatatctttatgcttataattggaaaaaaaaaaaaaaaacctctagtggcagagaatttgtatttctgttagctctcagtattgggattgtatttctgacaggctggcccaccagctatgcttcatgaaagaccatgagccacagggaagaggtttattcatctcagcattggggtattttgcttttcttcaaggcaaagggatctggagactcctttgcaggctggccatgtcttgtgcaatcccagctgtgtctggagattctagcagggatgcagagtgtggttgggacttcacaggaagtcgacttgcatcagaagcacatagggaaagggaagggaaatagaatgaaggaagaaagctttcagcagccaaggcaacaacttcccccgtctctgtctggctctggggccaaacagactcctgatttctctttatctccttgtctctccacctctattcctctgagttcttttcccatcaccccccattctttctctatatactgtttcgctgactagtcatcagactctaccgacaaatttacctgatcttcccagcctagcccttgagcttaaccattccatccacttctcaattccacatttcttggagagaatctgatttgaccaggtaggggcatgtgtctgacccaggtccctggacaagggaccgatgaaggccaggctgtgagagaagcagtgtctctaagaaaccctgcagcgttagggagaaatgattggtatctctatggtacacgtggtggagatgctggctgcacatcccaagagccatccctagaagatggcttccttcccatcctgtaaaccctgagtcagggatgcccccaagcatgtgagatgttgaccctatttctgcacttggcccaagtcaaatccagtcattgctattgggggtcttgttgcatcctgttgtttcctttgggaggtgacatactgctgacatctgtggagtgaagggatttggggaaagtgtgagtcatcatctctctgatgacattttattctcttattctccaaactctgcccagcttctttcttttttctttctttcttttttttttttcaatggaatctcactttgttgcccaggctggagtgcagtggcgcaatcttggctcactgcaacctccgcctcccggttcaagtgattctcctgtctcagcctcctgagtagttgggattacaggcgtgcgccaccatgcccagctgttttttttgtgtttttagtagagatggggttttaccgtgttgtccaggctggtctcgaactcccaaccttatttgatccacccacctcggcctcccaaagtgctgggattataggcgtaaaccactgtgcccggcccagtttcttatttaggaccctcaaggaagaattgttgtaaggaagatagcatgatcatatagggatatctccaggtgaaactcttccacctttacaagatgtatgctggtataacagagaggaacacccatgattacctatgtacctctccctatgtacccctagtcttctgcccggggaccccaggatgccctgcaacacatggaaataaaatttacctcctgactcttggctctcacagctcttatcctgaatctttgttttctagccctgcctacttatctattttgttttctggtgattagtgaacatggatcaccctccgaggctttttgttggcagggtacatgtctgtctcatttttgtagttctgtagtacaaatcagacagcaagtgctcaattaatccttgaacgaaacaaaagaaaggagtcagttcatgcaataatggatgctgacaaccctagcatcttatcgaaggtatgtatctccactgactcacccccatttcatcacaaggctatttcccacccaacagttgcaaaaatctgtcatctccttgtttcttatctgtctccctcactagaacataagctacatgagggctcttgttttgttaatcctgttgacaaaaaacatagcttctgttatttttatttggttggtctttattgaagaaataaagaccaaccaaataaaaataaacagaggctatttattcagagcttgctatagcaaggagtcagacatcctcacttgcattttgccagaaactcaaaggcaggcagaggagtaggaaaattttatagtagataaataaagggacagcttcagatatggcctggctagaggctgtttgcgtggggaagctgcagatgggctaagtagaaaggggtgttccttgtgatcggttaaggtgcacacttggctttctctgattggtccgaagttggaggtgtggacaaaaattaggaaagctgtcagttacgaatctagtcctgattgtttctgagccagtggatttttgtttggcttcctggaccagttactagagatagtaatctgacttccttgaatcgtgacttgtggatagcaggctggcttcctgtagacaataagctggtttcctgggctggttactgcaaactgtgggtcagatttctctttttctatatggtcttgccagtgtccatttgtgtatgcagtctatccttgatgggagggaaaattaaaaaggaaggaaagaagggagggaaaaggatggggacatcatagtactattatccagtttttattatccagattctatttcgaacactttaatcccatttcgatgtgagggaatagtaattcatcccagagcggacgtgacatctgttttcaggaccctttaatcatatcccgtggtccaaagctataacacagtgaagaggaaaaagactcttttcctgtcagtcgcccaaacgggagccaaaggcttttgaggaggcacttaaagaattttcactttgcaattgtgcagaagctgttgttcaggtaatttaacattgattttagtttaaaaggcaattaagacaaaatgggcagccaccagccacttatgttaaataagcttagatttaaattgctcctcatcaccacctttgttttctatgtctgggctgttctatgctactttagcatgggatggtgtggtgccccaagtggggcaggtggataggcgagggaacccagccagggaaacggttattgaaagagaaagaagttggccaaaaattgttctcagtggtgagatgagttccctttcatactgctgctgggaatatggattcatgtaagcttctagaattctggttccttagatctaaaaacttaaatacggtgcccacttttttgactcatcggtttcacttttaggtatctaccctgagataaggcacagagaaaaatatcataacatcaggaagtgatgttcactgcagtgttatttaacataaagagaaagtgtgtagcattagagtggaatacataaactgaccttgtacattttttgtccttacagcacaaagtgttcatgatacattgcaaagtgcaaaagatgaaggcagcttatacagtaacatcccaattgtgtgcttataatgttttagttctatatgcagtagaaaatgtctgaagtggatagacttccaacaaaatagtacttggagctctctttgggtggtgaaataatgttagcttttctggtgctttttgaaatttcctaaactttccacaataaacactcataggttttataattataaaacacattgaaaacaatgttggttgtaatactattagaagaatattcctgtcagcagtgtgcttgattcctgccatctcaaggatgaggctatatgtgcatgctaagttataaggagatggaatggatattcggttgcaataattctgtttcttgcttaaaggaagtctgctacgcttcaggaatgagggtcattcacctggtctttgtttaaatttgtaaggtgaaccattttgtagacaatgcttggaaaatatgcccaggtgattcatgcatttgtctattagaaaacgtggtcacttaccagcaaccaatatagagctaatgggattcatttagaaatgtaaccacaagtccactataaatcgtatgttctcccatctcaatatgcttcattaagctcacctttcttaatgtaactggattattaggtgtcaggacaaagaaaatcagtaggtcctagtgttctaatcctgcaaactttcaatgtggttgctatgtaattttatttttttaggtggagcttgctttgtgcttttctacaggaaaatattttcaaactggtaaagaagtaatattactgtattgtgaggaatatttcaataggtcattaccataacttctagcagaaaggataatctacgtcgcattttacttcaaggataagattgatttttataaaaatctttagtgcattgaggcttaacgtctttttttccccctatgaagaagcaattagatgctggagttttccagaaatgttaggtgggcataaaccaaaccttgatgcttttctttttgaaggttttatcatccagcgtttgaagagaacaggcagttcccaggtgaaaaaaaatgttattggtacaatgtcagtcatcgacactcacatggccagggacgccacccttttcttatatttacatctgtttgaaaaatagagaaatacaggaaatgacaaagaagaaaataataagcacctataatctcactagcaaatactacccattttgtatgatttcttccaggggtgtgtgtctacaaatatccgtagagacatacacatacactttaaaaaaatagtaaatacacatcttgtacacttaaagcaagacctatagatgtacaggcacaccttggagatactgtaggttcagttacaagccactgcaatacagtaaatatcataatagagggagtcacactattttttgtttcccagcgcatataaaagctgtgcttttgtaccatactgtagtctattaagtgtgcaatagcattgtatctaaaaaacgacgtgcataccttaatttaaaaagactttattgctaaaataaaaatgccaacaatcatctgagcctttaatgagttctaatctttttgctggtggagggtcttgcctcggtgttgatggctttgtactggtcagggtggtagttgtggtagttgctgaaggttggggtgactgtggcaatctcttaaaatgaggaaacagtgaagtttatcacatggattgattcttcctttcatgaaatacttctctgcagcacctgatgctgtttgacagcattttacctaacgtagaacttctttcagaattggagtgaatcctttcaaactttgctactgcttaatcaactaagtgtatgtaatattctacattctttgttgtcattgcaacaaggatcatagtatctttactagatgtagattccatctcaaggaaccactttttctgctgatccataagaagaaactcctcatctgttaaagttttatcacgagattgcagcaatgtagttgcctcttcaggctccacttgtaattctagttctttagctatttcctccacatttccaggttcttcctccactgaagtcttgaacccttcaaaatcattcttgagagttggaatcaacttattccaaactcctgttaatgttgctattttgacctccttccatgaatcttgaatgttcttaatggcatctcaaaagcgaatattttttagaatatttcagtgtactttgcccagaaccatcagaagaatccgtgtttatggcagctataaccttatgagatatatttcctaaataataagactggaaatcaaaattattccttgatccattggctgcaggaacctatattgcattaacaggcacgaacagaacacttatgtccttgtgcttctccatcagagctttccggtgaccagatgtgttgtcaatgagcagtaatatttttaaaggaatccttttttctgaatagtaggtgttaatagtgggcttaaaatattcagcaaaccatgctataaacagatgtcctgtttcatttctagagcataggcagagtagatttagagttattcttaagggccctaggagattcaaaatggtaaatgagccttgctttcaatttaaagttaccagctgtattagcccctaataagagcgtcagcttgtcctttgaagctttaaagccaggtgttgacttctttctatgaaagttatagataccatcttcttccaagagaagactgttttgtctacactgaaaatctgtcatttagtgtagccaccttcgtcagtgatcttagctagattttcagggtaagttgctgcagcttctccatcagcacttgccatttcaccttccacttgcatgttacagatactcctccttgccttcaacctcatgaaccaacctctgctagcttcacactttttttttgtcagttttcccacctctctctgcctccatagaattcaagaggattaaagtcttgatctggattaggctttggcttaagagaatgttgtggctggtttgatcttccatctaaaccactaatactccacaccagcaacaaggctcttttacttattagtagtgtgttcaagggagtagcacttttactttcctttaataactttttcatcacattcacaacttggctagttggtgcaggagcctagcttttagcctgtcccagcttttttttttttttttgagacggagtctctagctgtcacctgggctggagtgcagtggcgtgatctcagcttactgcaacctccgcctcccaggttcaagcgattctcctgcctcagcctcccaagtagctgggattacaggtacctgccactacacccagctaatatatatatatatatatatatatatatatatatatatatattttttttttttttttttgtatttttagtagagacagggtttcaccatgttggcgaggctgttctggaactcctgaccttgtgattcacttgccttggcctcccaaaatgctgggattacaggcgctgtcccagctttaaaagtgtcttcgtcatgaagcttaatcatttctagcttttgatttaaagtgagaggtgtgtggctcttcctttcacctgaacacttagaggctattgtaaggttatttattggtctaatttcaagattgttgtgccttaaggaatgggaaggccaaggagagggagcgagcagggggaatggcctgtcagtggaacagtcagaacacacacaatctttatcaattaagtgtgccatcttatatgggcacagtttttggcaccccaaaacaattataatagtaccatcaaacattgctcatcacagatcacagtaacagatctagcaataatgaaaaggtttgatatattgtgagatttacccaaatgtgatacaaaaacataaagtgagcacttgctactgaaaaaaagtggcaccaatagacttgctcagcacaaggttgccacaaaacttcaatttgtacaaaatgcaatatctgcaaagcatgataaagtgaaagacaataaaatgaggtatgcctgtgtgtgtgtgtgtttgtgtgtaagcgtgtatacaactttaaaagtttcatactgtattagtccgttctaacactgctataaagacatacctgagactgcgtagtttataaagaaaagaagtttaattgactcacagttctggaggcctcaggaaactttcaattatggcggaagaggaagtagacacatcttacatggcggcaggtgagagagagccagaaagatcagggaactgccttataaaaccatcagatctcaggacgctgaggcaggcagatctcttgaggacaggagttaaaggccagcctggccaacatggtgaaaccctgtctctactaaaaatacaaaatttagcccggcatggtggcacacacctgtagtcccagctactcgggaggctgaggcaggaaaatcacttgaatctgggaagcagaagttgcagtgagctgagatcatgccactgtactctaccctgggtgatagaacgagatgctgtctcaaaaaagaaaaagaaaagaaaaccatgaaaccatcagatctcatgggaactcacccactatcatgagaacagcatggaggaaactgcccccatgatccaatcacctcccacctggtttctccccttgacacatgggaattatggcctcttacagaaaaaagttcaccaatcaccagtctaggccaggcacggtggctcatgcctgtaatcccagcactttgggaggccgaggcaggcagatcatttgaggtcaggagcttgagaccagcctgaccaacatggtgaaaccccatctctactaaaaatacaaaaaattagttgggcatggtggcgggtacctatgatctcagctactcgggaggctgaggcacaagaattgcttaaacccaggggcagaggttgcagtgagctgagatcgtgccactgccctccaggctgggagacagagcaagactccacctcgaaaaaaaaaaaaaaaaaatcactggtctagaaaaatgggactgaaattcacaatagtgtcatctctaggaaaagaggaaggagactagtttttacctgagtttgagagctccttttgttcttttaagagaacacttatgtactggctttatgcttttaaaagtgatacacatgtacacacatataacatatagagtatatatacatacacacttttcacttaaaacaagttatatgtatacatgttatatgcatgtaaagggccagagagtaaacattttagacttcctgggccacttggtctctcacagacactaaactccgcatttgcagatgaaggcagtcgtagcaacccataaacaaatgggcatagctatgtttcaataaaacctcattcatggatgctgaaatttgaatttcctacattttttacacatcacgaaatattattcttcttttgacttttaaaaactatttaaagtatcaaaaccatttttaactagcaggctgtacagaaacagagaatggctgagtttgattcttgggctgtagttggctatcttctgttttggactgttcccagtacattcacaaatatttatatatctacggaaaacctataatattatattagtgcattctctttcagaaatggtgtcataagtgtagaagtcatttaaaacttgtatttttatctcagcaatttatttttgctgagaaatatttgtatatatatttgtaccttatagtgtgtatttttatttctgttcctacatattcatgtctatatagcaatggaggtattcatatgtggctttatttgattcttttcactgctatatggtattccatcatatgatatgccatatttttaatgctagatgggtatttagtctgttgcctccccccacaaccccatcctgtatcacaagcaatagcaattatatccaaacatatccacaaatgtatcttgtgcatgttttttaggacagacattagaagtagagctgtttgataatagggtatgcacattttccattttaataggtactagtaaatcagcttcccgagagacaatatcagtttacagtgctcatgggagactctactgccattcttggtttgggaggttgcatcccttcctgttttacttatggggtgggagcaagaaaacaaccttctctctgtatcatcttgccttgtagttacagctgtaaatgtgggccttcatgtccctttgggtggctgcagacatggttttaactgtttgctgtgccccttgcacatgagaatagcaatttatatcaataaccaggtctggcaacatctgccaaggttgtcacgctctgtgattaaatggccacatgtgctgagaacacgaggacaatggggttgtaattagggcttgctgtctctccatcggccacccgcaccatgcgtcccttcctataaccttgcttttgtgaactgatttgtgaatcaaattattccactgggcatgccagtgtgtgctgggttaataataatactctatatttgtgaatctctgtaattgtacagggttctggataagcgaaagtctaaacccctttttgccattttacctggtgctgttggaaaatgtgtcaggggatcatacaagataacattagaagttaactttaaaaatagtagggagtggagcatgttcttcatggcatcattattgtgaaataaggttttactttatggttatctcagcatccgttaaatgccactgaccctgtaagaaaggcaggcagagagaacacaaatagaattttgttaactctgcaaggagaaagttaaacactgtgttaatatcatattaaaaacactcttaatgcacagaagaaaaaaaaatccctcctcgttttgttcctggtatgacaaagatggatgatggttacataaggaattggcatgttaaaaaaagacacacttgaaatattgcctctagatatgaagttgtaacgaatgtgaaaatatttgaaagatttattagcattttaatatttgcttaccaatgcataaaatcctaatcagttgtatacaagttgtatactttaactcaaataaagtatccaagaaggacacaggcaggaagccaatgaatatttcactcattgttgatcaaatataggagggatatatgtatattaaattttatttcccatttagatccttcctgtttaaataagtgcttgaggtagcaaagccatcttagtgcacacagcttgcagttctaactgtgaagagaaaggaaaaagaacaaattagtttttctacatccaagagtcatttccccagccaattaattttttggtccctaccaaaatcagcacttaagctgaagatagctagaacctgtgtaactcattcctattaacaacagcaacaaaaaaagtgaaatagatctatgaggacttcttgggaaaataacaggaaaattactttgatgatattattattcaaggtacacatatttaaaaggtgatctctaaatttcaacagagacgacagttgtttttctcctaaaagcaggctgaaacctcagcgcattctcatttagtacgtaacgtggaaaaagagttgagatcctaaagcttcgctcctaaataaagtgcagctgcttctcggagatgaaataggatgaaagcctagctgtttggggcgggaggcgagattgggggcgcggtgctggggtcttcgatgttttaccagtatttctaggtgaagcagcatattggaagtcataaatactgtcccgtggacattctgaataatgcaggagtagcgtaagtaattgggagtgcttatatccgcctttagacatttgattgctcgtgagttaaaattggttgtcaagtgcggactcagggaaccgtgcaaggtgccctattctgtcatgtggtacatatttaatgcctgaaagaacaagggaagggacacgtgcgggcgagagagggcgagcggcgagataccgcagccagctcggagctttgcaagtgcctccgacccgtaggggcgggacccacgcagccccagtatccactgccttcccccagctgcaagagtttgcaaaaacattgggcgtctcatttggcgagcgttttggcgcggacagaggccgaggccggccggggaagccggacccgggccctggcgccgccgtggcctccctttgtgcgcgcccgggtgttgattgcctccttgcacgggctgctcgctctcgcgcccgcgcgctcggggcgttctgcacctgctggcggtcgtgccaggcagcccgggcgagcgaaggcgcgcggcgcgcacgacagatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggagtgtgcaaattgacatttttggctgcctgtggcagaggagcagccgtcagccgctgtccaacgttagcgcagacacggtggcggcgtgtgcgcctccggggctgctgattagaataggggacttggccgtggatggaatccgggaaacccaaaccggagatggaaggatgaggctgcgtttgcagcgcgtgaatgggacgcggtatgtaagccgagctccagctccggggacctcggagactgtgctcagggctcgccctgggtgccccgtggtgggggtggtctggacacttggagagggctagggggcgtttagagggattggggagcccggagatgcatcgattttctttacccactggaagttagtgggcaacttccttgccaatgctcattggctccgtttaactttattcccagagatgaataagcgtttattaagaaccgatgtaaaagtcccaataggctagccatggttttgcaagagatgcgcggctctggaaatgagaggtttatgaaatgaatggccagatgggttgtgcatttgcgaagttggcatgctcacgttgcaagggagcatgtgtgtgcaaatgtgagcatatgcgctgcatatctgtgtaaacatgtccaccatgctcgttgcgctggtgtactcttcatcttctctgcctgtttcccatggaagagagattaaattgacaatactgaacacgcttcgacttgagaaataagctctgtaccattttatgacatggaataagagttgccttcttctgagatcaaatgggagaaatgtgccttgccttctcaagtgatggaatgaactgttatgcatttatagaatatattatatacagagtgtcgaatgtgacatccatcagtctacaatgatcacctagcctctcaagcacagctcatccctctagcccttattttcagattatggggaaattgggggttttattatttcttttgacaaaagagctgcgttttccaccttcctacttaagagggctccaagcagaattgtgaatccaaaagttttgttggcagtgtcaccttagtaaaacgttatgaaattatttgctaaaagagtcactttctgagtgtcttcacgtagaagaatttactcattgttgacatggtttcaattttggttacacagaaatgaatgcggtttattgctgaagcaggcaaaaatgattgtgtaatcctctctttagtagggtagctgggtagtaaattgtttggcttaaaatggggacatctttctccactgtgttccctattttttgatttaaatgtgtgctggaaaatccaaagagtgtgagtaaaagggtgtttgtggcatggagtaacttgcctttgtggtttgctatgactaagtttgaagagggttgtttgttaagtaagtgaatgcaagtcaatcagcaacagctgcttgccactcaggctcacaggaatccaggcttttcatttaaaaagcaagattttccaagtcttatctgcccacacgcttcccacacgtgtgatgcctcccctctattagaatactcagaggttatgaagagggaattgttaatctgaggaatgaggtagggggacatgtagaaggagctcctccctccctctcttacccctcttctcttctctctcttggtctccctctgggtatttcttcctccttatcccattttttttcatctacgtgtatttctttccatctttctgtctttactgttttacctggtgcacagaaaccttttaggtatctttgctacactttaacatatgttttgcacgctggaggatcaccagagcctgtttttctttctttctttcaggaattctccgctcacctgcaagaattatttagtatcaggcaattccactgtacagcagtcttataaaaagtgaatattcaaacttttttatcatttctttttaaccaagcaactagactctttgaaaacacttttactatgtaaaaagagcagaatcttttctgttaccccaaattgagggtttatacgaaagtactttctgtctcatgactttattggactaagcttatttttacatttgtctcttaaaatcttatccttcaaacttctgtttttcctatcacttgtcttaattttagagtctggattcattttaatctgtatttactcagacttggtagaaataactatcagtgctgacttatgggccaggtaattgaagtacaacaaaaatagtttttcttttttgtatgatattgtgttcctttttgctcttaaaaaggaccagctaattatttttctttttttttttcctctctctactaggagtatgatacaaaagttgaaggagatctcagtaaaaggctttttttttttttttttttttttttggcattgattgccttcctataaactatagttgcaatatttggaaaatatattgtcatattttatgacactaattggtgtatatgacttttgttttgagaatccaggtacacactcctcattgttgtctttgatttgattatagacaacctgcttgaatgggccaatcttgagctaaacaaatattacaacatctagtgaagaacaaacttggtcttgttttctgtctaaatttataatttttatattagattttgagcacagttgtaatctggtgaaatgaaaagtcatctaaaagaggaagaagatatctgaactaataataaaatgattattattaattaaacttagttgtgtttagcttttagcttttattttaaaaacttcacgtgtcttagtctcaaagttatcaaagggagttggcgtaagttcttggaaagtaattctgttgggattaaaagtcctctctatgagacttcactctccatcttgtgttgattttctgacgaacataaaaagaaatgaggaaaaagcttgaacccttaattttattatttttttttttggcattttagactttactttgttatggatccaaaaactttggagtgtgttaaaatatcaaatctttgtttgcatttatgggtatgcgtttttgctctttttgttttctttcattttcatgcagggttgtgtgtttgtgtgtattatgagcagtagtcaacaggagcaaatgagaagaattttacaattatgaattctcatgcataatttgattttaattaaatcatagataatcagaatagcagtctcaaggatttaggatccctgctgaaccccctcttcttgcacggcaccaagagaaagataaaacgcctttaaaagtcagcatttaatatacagtgtttggtttggaaaccatcgcatattaaattattcagcaactataatgtcccaaacagttttcagggtgtgtttttattaagctaaataaagtttctatgaaaagttgtggggtttcagtaagttgtggggtttctgtgtgtgtgtgtgtgtgtgtgtgtgtgtgtgtgtgtacccaaaaggccgaaacagcttatgtcagctacagcaactcgtttttgattcagcaaaactaggttatgaattcaagcaattaaaaatgacagaaagcccaatttcactgcctagattaatatgcttccaatttttcctgctccataaaaatttcaaagtgttctttctgttgaggtgcttgcataacctatagggtattgggagggtctccatttcttgtttgcttatgatgtctgaatactttgatgtagcaaatgtaaataggatcagttggatatttgtaacataattttgtgcttgcaagttctcctgaaattattttggttgggtttaaaagaaaagagctgtggttagtttctaagcatttaccgatagtgaagaatctgtcggcaagctccaatgtcatgaaggccaggaaagacttttcaagaaaagatacaattatagtagaactagtgttttcagcttccaaagatggcagtgatatatgtaaaaaaaaaaaaaaaaaaaaaaaaaaaatatatatatatatatatatatatatatatatatatatatatatatatatatataaaatattatgcagtgatgggcatgtttattactttttctctattcctaaagtaatgtctggaattctagattcatgtttatctaatgagccaaatctctccctgttatttaaaatggtcctttttccttacacactaattagtagtcaaaaccagccgctttaatgatctgtagtttttggtttgttcgttaagttttctaacctggtttgaattaacttgttcacacaaagagtgtacacagacacagatatacactcaaaaagctcatctcccagcaccatttactccacgctttcaatccaatacagaaagcaacaaccaaacaaatcaaggtgcactatttgcccaatgtttgttttacagagaagacccctaaagggctgtatatgaggaaggcctctgccagcccttcctttgctcttcatggtaattctgcatctgcatttgccacagtactgtggatgtatttctttgttgtttagttgtagtctctagttgtgaggaaatcagttgttgtctgcaaagaagatgtaagtactagttggatttattgtggttagctgaatgtgtaagtacaggtcttccatttgtattaaaatgatgaggatgaggatgtgataacctgtcaacagaaacagcagtaacaatacaatgccgatttcttcccgggcacttactgactccctctgtgcatcagacattggacgaggagctcctgtgtattttctctgttcttacaactctgcaaggtaggtattaccatgcctaatttagagatggagaaacaattttcaagactttttataattagaaaaagtgattagactgcaaatttttctgattccaatatgctaagataccattgaagtttattaatctgagtttagaatttagcatttagaatctgtttacacataatgggtacttaagagatacactacgttagggtttctcaaacaggatcaatttcctcccctaacccataataatatttaacaacattttgaagacagtttttgtgtctttgcgagaggatgactccctcctgcaaaacaaaaacaaattacctggccccaaaccaacagtgccacagctgagtaattataccctaggtaatatcagtgatagtctaatataaacatggtctgatttttcaagagagggtagaaggtatgtgtacttcaattattaaacatttaaaatctctggttggatactgtgactaggatcatgatgcaaaatcagacggtccttattcccttacagtctgacactaaaattgttacagctgcttccttggaacatctttctttataaatatggcatgggtcgttgtgatttaaagtgccctatttttttccaatttacttactctttagtacgagaagtgctggaaaatgaaatttctttccttggtactcttgtcactagaagagaaatgtaacgtcactaaatgaataatggaagagcaattctaacaaccttcccatatggtccttcttttccctcagtattcaaatggcattattttcctcttatctttaaaggtttggcacataggtttattggtttatttgtttatataatattttatatttgccgagcactcttgcaaatgctttaaaatattaattcattgaatctttaagataagcctaggagattgttattgtttttatctactttttacaaagagggaacagacatccagagaagttgagtaatctgtatgagatcacacagcttctaagtggcagagctggggtttaaactccaaagtctgtgttcctagccattttctcatgtactttagtaatttgagcttctaaatgtacagaagcctaagcgttgaggcaccatcttcacccgagttttgaaacaaaagacgtttttagtctcattttggagtgcttgatgaggaaaacggacttacctgtttttgaaagagcatgagtgataatgctcacagctttatatgttgctatttaaatactcctgcagatgcacttcacctgggtcaggaggtcttgtgaattctctctaccatgaccacctccaacaacagcaaaaaagccaccaaagggaaacactaatgtacaggagggcacaatttgcaggatgagtgatctccattttatcccctacttaattgtcatgttggaaaaatagagagaaattctgcaactggatctcctaaggtgtcttcaagaaacttaagtctttgctttctgatgctcttaaaatgttctagagagccccatgtggtccatgccaggtgggtgatggtggatgtgagtacgttgactcccagcttgatctcagctaatgccaggctgtttgttgttccacatttaggccacgggaatgaccatgcctatctcagtctcagttgggtttttagtgaatagcaaatgctatgaaaagaaaaacaatttaagtatatttttaaatagaaatgccaatttgacacattttattctgctttagaagggaaaaaaagatcttgcaagtacgcaattaaatacataccagaatatccagaaaaccaagacagaagtagagagcgtcaatgaacttcagttgaataaatgagtacatggatggaacattttgtatttttcaaaatttcttgtcaagaatatgtatgggtttgtacttgaaaatgtctcacatctcgaatacaagccaccgtggtgggaaatacaggtctgacaggcgtccatttcataccagctgtcctcagcttaccaatctaaatttgtacgttacttaagtgttaggcataggtatctgcttactatttattgccctgcagaaagctcagagatgattaagcacagcttacaagtatggactgcattttacctgaggcaggacacagatttttttatacaagaaagaaagggtcacccatgaacagctcgtatctggtcatggagcaatattaaagtctcaaaaagggctgttgagctacctcctcccagcctggagacagtttaggaactgggctggaagtggaatccattactgttctttatatttcaggcccaataaactcacgtttgaacaaagagagcgaagagtgaatcccattgcagaactgtcaaaagactgatgttggatccattactgtcaaatgtccttttttaatacagttcattaaattggcttttgtggaatacctatttcatctaagtgttggttcaggaaatggtttaaaatgaaaccagaatttgttgttcagtgggaaaataaatgagatgaacccacataaccaagactacccagtaaagttctgtagatactatctattagtatgcagtactaaaatttaaattatacgtgtatatatagttatatctatagttaagctatagatatgtaacttatgtatagactagaagctacatagtctatagtctatttatatgtacatataaactatatatagatatatagttaaactatatatatagtttaattgatgaaagaaagaatgggaagttggatttaaaatagccattttaattccatatccagaagtatatggaatacttccgcatcttaaggtgagcctccttttagaaataaagataactagtgataaaccttgtatgccattaaaaagagtgtacccaacactcagtgaatttctgcccagtcttgattgtgaaattttcttaggaatctaaacatatagaagttacatcaatgttataagtggttcaggattcacattctgctgctgacagagaaagaaacctgattttgttgtaatgtactagctaattgttcagtatatagaattgcacatcattatccttcttattgatagtgtctattgagtgcctgcaataagctagacactgtactaattcccagatgtgcattattggcctgaatatttccagcagccctatgaggcagatgtgattgttatacccagggttcatgagggaaggctgaaacttgggatggtttttcaagggttaccaacagctagtgactaaaagggctgctaatcaaatttgaagctttgaggcttcgaagtccctttccccgtttttttggcccaaagctatatcaatcattgttctaacattggtgaaaaatgaatctgatgtagatgaagagatttatgtagctataggaagttcctataactctcctattaggattaaccttcttatcatcttggcaaattatgcaagtggctggatattttgggtagatgggtggatgggtagatgaatggatagatgagtagacatatagactgagtagtaatggagaagacaaattggcaaaggacatgaatataggttttggaaaaataaacataaatagcaagtatatgaaagtgtgtgtgtgtgtgcgggcgtgtgaaagtttcccttgtatatgtgaaagttttatatattgtattggaaaataatttgttgatgaaacaggcattttatatactgttagaatgtggaatagtaccttcttctgtagaggactatttgggaattcttattttgaaaaagtaggctgggcacgatggcccacgcctgtaatccaacactttgggaggccaaggaaggaggatcatgaggtcaggagttcaagaccagcctggccaacatagtggaacctcgtctctactaaaaatacaaaaatttgccaggcttggtggcaggtgcctgttagtcccagctattcaggaggctgaggcaggagaatcgctt[135 bp omitted]cctttctgcctctggaatctgtgtgatcgctgaagtttgtgaagatgcagcttggttcactgccgcattgtgaacagtcagaaggaaactggagcggaggaaatacctaagtagggtgattggaggtcaaggacccttgtaggaatgaagtggatttgcctggatgtaaaactacatctaagatgttatgagtgaggaagagcccaaaactcagaaatctgtttgaaaaactttgttagaaagcaaacatacacatgcaattgttttacatagagggcaatactgcaaaagataatgaagggactataaacagtgattatctttgttgtagctgtgcagtatgactaagagaggggcagggaagagatgaagcttttgcttttaagattacacctttattctttgtgattttcagcaaagatgccctatttggataattaaaaaatatttaagagaaaagcctccattttgcaaacaacctgtgatcactttacccctgagctgatacaggtcagcttagataccaacataggtattctgtgttggacataggcaacctaaattgcttggaaaatatatttgagccttagaaaagataaaactgaaaatcattggattcacagttatgttttggttgaggtttggggtcagtatgctctttggaatggggtggtggggtgttggaatttcctaaaaatattaaatatgtgttaacagtaatggtttgaccacagaagaaaatcaaatttccctgttgctgtacacacttgtcattcatcgccggtactgcaaaatcatgatccttatcctcccagctgtgtgtgtttgtcagggaccgtaggctgctaaaagttgtatacagtactattattttttttattcatctgtgggtcatttcatcttcctgtgcaagccacatgaatagctgtgtatgaaaattgtattttgtgccgaatttcccactgtgaaagatgtttactatatatttatgaaaacactgcagtaacaaaaccctttatatagcctttcaatttgctgtaagggcagataaaatatttttatctcaaactgaacttcataccttgggagattcagctggcctgactcagaataataaaacacttcagagaaaggcaggtgctgttcagattgcttcagaaacctgtgcacttcactcggcagatttcacttcctttaaacacgccaactgaatatacgaaagctagaaataatcagtataaactatgcaacgttaagtacaagaaatcatctttttttattaaatagtttcttaatacatctacagtagcatcagcgtgatttttaatgagtgatattttcctgtataccagaagatacagagagaaggttggcgatcattccagtgtattgaaaactttcattcctcatctgcatttaggctttggcaatgttcttaattgaaatttttacagagataaatgtagcatatgcagttgtaagaaaatatagatagatctcttgtacactattctctaatggtaatattttaccaaactgtagtatcacatcgtatcgaggatactggcatggctgcaatccactgaccttatttgaatttccctaaggttacttgcacgtatttgtgtgtatatatattgttctgtacaacttcatcgtgtgtaggtttctgtatccaccgccacaggtaaggtactgagcagttccatcctgaggttccatttgtataaccacagctatctctcgcgaccacctgcccctgttcttaacccctgtcgatcatgaatctgccttccatttgtaaaactttgttatttcaaaaatggtatataagtgagatcacagagtgcttagagttttgggatgggcttattgactcatcattccctggagttgtacctacattgttacatcagtaattttgcatggtatatatatgtaccacagcttaaccattcacctgttgaaggatatctgggttggctttgaccatcacacataaagctgtcttgaacatttgtggacaggtttttgcgtgaccgtgagtttcacttctctggcataaatgcccaggaatgggccttggagatctttgatttatgcatattatggaacacatcaatatgttgcacccattggaagtcaatgccagttgcgtacaaactgatacaaggaaaaaagaaaattgtacccacgtcttaatgtttatttttacataaacacggcactaaatgcagagaatagccagcatttatgtagcatccaccatatgccaggctgtattctaagcctgttatgtatgctaactcatttgtcctcagagcagccttatgaagtatgtactactgttcttacttatggaggaaacaccaagcacaaaatggttaagtaacttgcccaagattatacagtcatcaccacttagaggtagtcggtctggctggagaaccccgcattttaaccactaatcaatgtccccgctttcttttgtttgtttatttatttatttattttgagatgaactttcactctttcacccatgcgggagtgaagtggtggaatctcggctcattgcaacttctgcctcccggattcaagcgattcttttgccgcagcctcctgaattgctgggattataggtgcccgccaccatgcctggctaatttttgtattcttagtagagatggggtttcaccatgttttccaggctggtctcgaactcctgacctcaggtgatccaccgccccccgcccccgccttggcctccctaagtgctaatattacaggcttgagcttccgcgcctggcagacagccatctataagatgatgtccccactttcgtagatcggttggtcataacttgtgggttggctgagacagtaatattcatttagagtaaacatctattgatatcaccctgaaaagaaataataaatgaaactgggtatatagaataatcagctagctgacttcatcagcccttagctcacagctctgccttaaagcttgctttatttggccgtttcagacagatggatgcctcttatggcttttggatctccaagacgtagatttcacaaccctcccttggttacacactgtaatatttaacagctctcaatagcagtatgttctgcttttttggtgtggcccaaatctctcctatggcaaactcaacacccctcactccttcttcccacctattgaagacgtggaattgttggttgtccattgtattcacaacataaaggtatctgtttgtaacagaatattgtttggctgctttacattaatccttgagcttttcgttcctccaaaggcattttatatttccaacaggcttataaagtatttaatatttttatatgcgtcagtgtaaagccatctgttgcagtgacaggacaaaatgtggaagacaagaacaagcgtatgtttatggaaagattccatgaaatgttaacaagaaagatatgtgctactctggggtgtcttgtagaaaacggtcaggggaatttggaaaggcatggcttacagcattggtatttgtaaattagtgtttataaaaggcatgtgcactttttttttctattgtcctgcaaatttagactagattgttgacataaatggtgacagtgaccactctgaaaggaaatggtggtgtgacctaatatttggaacttccttcatttgttgttcttcattcacaggcttcaactttttccttttcatttgaacaagtggattgggaacctgctttgcggcaggcgtttgtgttgctggaatagctagattgtgtttctaaacagctagaactgtttctcagtgccttacttttaatagccgtgttgtggtcttgctcatacagaaacaatcagacgggaatcaattttgcctgcccacttgaacgtatcagtttaggcacagttatccaaagctgttgctgcattacattgcccctcgtcgaactgggctcagaaaatcaaagcaagttgccccaagcgaagacaccaatgctcttggggaaacacatcacagctaaattacagcgagtattggccgggcacggtgtctcatgcctgtaatcccagcactgtgggaggccagggtgggtggatcgcttgaggtcaggagttcgagaccagcctggccaacatggtgaaacgtcatctctactaaaaacacaaaaattggcctggtgtgatggcgggtgcctgtaatcccagctactcgggaggctgaggcaggagagtcgcttgaacccaggaggtggagattgtggtgagccgagactacgccattgcactccagcctgggcaacaagagagaaactccgtcttcggaaaaaaagacaaaaagaaaatgcactaagtatagtatctgccaagtactacgagaggcactgtgtcttggttggcttatatgaggctctcaaacctcttaggtagcataagaagtcattgtctccattttacagatgagggagcaattttagagaaggtaattaaccaaatattacattgctaacatggagtggactgggaacttggcaacaggccgactaaacccacaagcagcttgcttaaccactgtgttttgtaactgaggctggagaaagaggaggagcttgtgaggtgccttccagaccagctcttctcaggtgggcattagctgggatgtgtgggtcaaagatgcagtatgttgttgagatgtgacattgacatggagcttgatgccctccacagactttctctaaaagttcttcatttctcagctacttttcccactctgtagatagtcacttctcaaggcccagagagcacttggagaaagaagttggtgtgaactctagaagaacagctcttcaaaatgccgcaatggagcaaggacatgtggaataacctccagtataaatcctttacaccgatttttgaagtttttaaaaaaaaaaaaaaaacagagttttgctcttgtcacccaggctggactgcagtggcgcgatcttggcttactgcaacctctgcctcccaggttcaagtgattgtcctgcctcagcctcctgagtagctgagattacaggcagataccaccatgcctggctaatttttgtatttttagtagagacagggtttcaccatattagccaggctgacctcgaactcctgacctcaagtgatccacccatctcagcctcccaaagtgtaggtattacaggcgtgagtcaccactcccggccctattttatattcacaagtgtgagaaagtgcctaaaagcattcagaggttttcaatcatatttataaataaattaatcactgttacccatgtcaaaagatgacaattccaggccaggcacagtggttcatgcctgtaatcccaacactttgggaggctgaggcgggtggatcgcctaaggtcaagagtttgagaccagccttgccagcatgatgaaaccccgtctctacttaaaatgttataaaaaatagccgggcatggtggtacgtgcctgtagtcccagctacctggaaggctgaggcacgagaatcactactacctgggaggtggaggttgcagtgagccaagattgtgccactgcgctcaagcctgggtgacagagaggaactccgtctcaaaacaaaaaaaaaaaaaaggatgacaattccagatagctattcctaggttgataaaattactgagatagtagaatttagagagacttatgagcagaaatatatattgacagaagagcaaaatatcattgtatttcgttaatagaggaacaataatcaggctatctgaaagagaagacagaccagttagcttctaaatgctgttcatttatttcagtcagccttctcagaaggatattggggcttggttcagcaatcaggcccttttagacccatagattttgcctgcaggtgttcctctccaacgattagattgtgatgataggctataaacttcatgaagacagagaacaggtgagcaatatacaattagttcctagcacaatgtctgcccatattaaggacttcgataagggtttctaaagaatgtgtgatcacattggattgtcccagagtatttacaatgtattaagtcctggaaaatctaaataataattatatctataataattggataatgtttcagagtcctattgaggaaagatagtgttattcccacctgctagttcttctcctgaagccaagatatgcatggtaaaagccatggcacagttagtatctgatccctcaactaaaatactgacaccaccttctataggcttatacggcaagtagcagtatgccttggagccttctcctccaatacaccccattggcaaaaagcgacttatggttaatgcaacagtgaaaataaattattaccattctatgattgtgtgacaggttagtaattaacttatgtcaccagttggcttcgcacaactgtgtttattcagctccgtggagcacttttcagggaaaaagaaattatcagccaggcagcctttgtttactgtggaagctggatgctggtggactgcatctcctcctattgactaggaaataagttggttgttaggacatgattttccattcttcaaaatgatatggtgatgcaaggaatttgaaagctacactggaattagaaaagcataaagaaattgccttttatgcactaatcgagccattatgcctgtttcctttggggtatttttttactgtatagacaccacaaacagccatgtgtaaaaaaaaaaggtatgaaaaatcttaattaaaataaaaactgtagtatgtgtttttatcccattgtaggttaagtgggtatcacacagcctagggacaatggtattagatttgtaataagcacaagtaaagcttttcattttgattggattgggtgtatttttcatcagcatctcccgtgtgagccatgattccaagacagagtcttgtaatcttctgcagtgggaatgattcagcttaaaaatcagtagggcatgaggtatttcaagttctcattattgtaatgtgtcaacatcacttcagtgaccccagagtcctatgttggctggttttccccctgatttattgtgcaatctcgtagggcaaactataatttcacttggaatcagaaagtctccatttatggtttgtgtcccagtctccagtcattagggcattcgcgggtaatcgatacctcctcttgttgctaacagctgaatgaagttgtcacctgcttagattacaaaggagtcgggtaaaaggatgtggtaagggtgagtacattgaacaagttctgttttgagaagggctttctctgatgtttacctgccgcctcgtgaagggctttcagcattttttgggacctcctttctagaaacccttatcactgaattagcacaatgttttatttcttcttttgtgaaccgggtgtgaatgatgtcatttcctttggttaaaaaacaagttgaaggagccattcttgaaagtctgcatgctgacacattttctagaaacctttgagtcacgccaactctttttaaatacctggtcatcatgctacaattaaaagaatggtatcttctattttttcctaattggcaaaatacctaggagcttattgaggcctttagcaagaagaccatcatctgtgttcaacacaccatgcttcaaggtatacacattctattttgctgcacatggacatggatgcacgtgtgcacatacacacacacacactcagagcttctcactagaggatattcactgaccatttatatgatattgttaagtcacacaaagcacagtgactccaaattgcagctccaacacctagtacttggccaagggtgagaaggtctacacagatcaacttttgcagaaatatgattaagtcatctcaggaatgttccataatattctgaacacaatagagtcccttccctcaagaaaattaatatccagccatggaaaagagccaaggtgaagaggcaattgaagtacatggactgtaactacagaggcttaagaatggcaagaagaggcattgaactcagggtcttagaaaacttggacactgacatcaacacttgacaacatcttgactgcatgtcaagatgttgttattctcctcacaaagattataaaccaactgtgatatgtgtgcaggagaaaaatcatcgtgttttaaagttgaccttgtccattaagatcattgtcttttatctcagcccttggggagtagtttttttttttttttttttttttttaatgctgagacatcctctgtcccttgttaagttttgggttggtgttgctggaccagccatgttcctgtcttttcttcctatccttcctggcagagccccttcctcccagagctacttcagcagggtaggatggtctcactgcccatgggagtctgcccctggaccctatcctgcttgatgagttcagaggtctttctgctgagcctctttgtcttgccagttaaacattctttttttttttttttttttttatttcacttgaagttttagggtacatgtgcacaacgtgcaggtttgttacatatgtatacatgtgccatgttggtgtgctgcacccatcaactcttcatttagcattaggtatatctccaaatgctatccctcccccctccccccaccccacaacagtccccggtgtgtgatgttccccttcctgtgtccatgtgttctcactgttcaattcccacctatgagtgagaacatgtggtgtttgtttttttgtccttgcgatagtttgctaagaatgatggtttccagcttcgtccatgtccctacaaaggacatgaactcaccatttttatggctgcatagtactccatggtgtatatgtgccacattttcttaatccagtctatcattgttggacatttgggttggttccaagtctttgctattgtgaatagtgccacaataaacatacgtgtgcatgcatgtgtctttatagcagcatgatttagaatccaaacattcttatagacaagggctccttctcctgacgtttctgatctcattctaaaacattcacccagtccactgacctgtactgggcgctgtgctgggtgccaggcactgcttttccatattcttttctaaactgctaaaatgggtgattattcctccaggctctttgctgacactggggggaaattcttcttggttttcacacccctcttaggacgtgtcttccactctggctttacttgttcatagattcatgaaatcctcaacagagatccttgcaagtgctgaggagatagtggtgaacaaaatagataagatttctgcttttgtaaagtttacattcttctagggatcgtgtgtccttgatttggaatgcctgcttaggggggtcatgagggtataaccctggtttcctagtttccagggaatgggttgggtcattccttgtgtaacagaatattacccaactggaaccaaaaaattccttcagtgtcccttcaggcattggctttagctagtaggaggatgtagagaaattttgtgcttctgttatatctttctcatggggagctatgcagatccatctgtagggatctagatcggctacaatagtagtggccccagagaaagttgacatcagaacccctgatctacctggcatgccacctttaagggctttaacttcagctctgtgacgttccctaggaaaatcccaagaagaggtgtcccaaaccagtggtataagtaagagcttaggtcttgagtccatcactaaagaccttgggcaagttatttaatctctttaagtctcagtttgctcatctgtaaaataggatggcagtataacccatctactattttaaggattgtacgacattctgcacctaacaccttagcatagtacctaacacataggagattttagtaattattaactactatgagagaggtcaaggaggggagggagaggtgccatccatggtggataagttgtgctagcaagtgtttgtatgtggaacttttctattgttaactcttttacctctgctaatttttgccattaccaccggacccctatgtaggactcatctcctctagggtaaggtgccccgatggatcatgattatcagcatcctttttagacatggatgtaagatacttctttcttggcattctattctattctcgctggttctggattgaatccaaatactaactggggttatgtccgttttatagcaatgccatgttacaacttgtaaaccgtcatattatgtagccacttaaaggatgaagtaggccttaatctgatattatggaaagaagataatatcgactcagctgagatattaatgtatagatagataaatggggaaaaggatggtaaaaagtagtataatatgtatttataaagatttagacatatggatgcatggatatattctcaacagacctaagaaactatgaagagtgattattcaaagaaaggatgctgagacttcatggtaggagcatactaccaatttattatatgtgatttttttattatttgttttcataacatttttttaataaaaataacgttaaaataaatcttaagcacagcccccaaatatctatacttatctatgggcagtctttgtttatctcttttccacttctccagacgagatgggataaaggagattgtagaagcctggggagtcatagcactcttgttcttgtaacagttagcttttgctggtaacaaacaattccaatatttcgtggcttaaaaaaatcatatgtttgttcacatttccctgggtggaccatgtgggctgtgctcagcaggacatttcttctgatggtttcatctgggtttactcacaccactgaaattgaattgcctagaatgtcttgacacacatacttggtgatttgctgggttgcctcagttttcttatttgtggccttttcggcaggcttgcttaggcttggtcagcaagctaacttgagtctcagggaccccagtgcagcagtgtagcaatctctaactgaggagcatctttcatcccttccatatgttgcattttctgatgtctactggaccaaatcaagacacacagccaatcccagagtgagtgatgtctcgcgatggaggaagcttcacactcacctggaaaaggtatatgcaaatggggatgggataagtttgtggccattgtttgcatctacccaggcctctttaaggcaagccatgcactgaagggaataatgctctacgaggaggatgttccttaagccggaccttcatccctaaatcatctttggcacttgaattcaagatacatgtagtctctccctttttaagagcagccttctatttgcttatacgtatgcatctttcttatcttttattgtttcagcaccactgataattttgctttttggttcttttttgttccttcagtgaaatggcagcccagaggtaaggtagtcagtagtcatatacctctagtgacaaagaacaacccctggataaagcaccatgtatcttcagggagctgtgcaagcctgcatgatagagctagcaccaacggtgttctgacaagtatgtcgattctgagcttctccacagtccacctgttgggaatctatttgctttggattaaaggcaccagtgcatccagcttcaacttcacattcccctgcccttcaccatcagacagtttatttcagagatcatttgggatctaatgtgtttgcttttctgattctgctggcactggtgtatgcttcaccattggtttatggatgcacagagtaccggggtagtatagagtgagaaaatttgcatgagacctttgtaatgtgaaacttaattaaaagtgcagaggactcaaagtaacagggagctagaatgagggatgagtttgcctatctacattccaaacatactgagtcttatttgacacctcatgttggtagatagatgggcaagtgtgaggggtagtaggtatgacctgtcccactgccatgttttccaaaagctccttgtacatgcattgaattgcatacttgcaagctttatcttacaaaagcagaataaagtgcatcaaatcggcacttctatttaaaaaacaaagtctggccaggtgcagtggctcacgcctgtaatcccagcactttgggaggccgaggtgggtgaatcacgaggtcaggagttcaagactagcctgcccaacatggtgaaactctgtctctactaaaattacaaaaaaaaaaaaattttgtaattttttaactgggctagtggcaggtgcctgtaatcccagctacttgggaggctgaggcaagagaatcgcttgaacccaggaggcagaggttgcagtgagccaagattgtgctgctctactccatcttgggcaacagagtgacactccgtctcaataaataaataaataaaaattagaaaaataaagtctactcaaattattttttttccttcaccagacttgggggtttctgccctagttatgcagtttcttgctcagtggttggatttgaagtattccttaaagctcttgattgtcagtcacttttatgtagttgtcactttcagtatgtcacagtcaatagcagaaatgtgaagcttgtagacattcattttcaccctgatattcatcactcaattgagctttgtttatataaggaatctaaaaatgcacacatttatgattagtaaaaatggcatttgggaaaaacttttcaacaggagaatatttggaaacaaaatgctcccattacatccaggaggaatgtgaattttggaaatcccaaataaaatcagaattgaaaaatattaggtattctcgaatgcagtttttagacacacgtttactctgtgtattctcaccgtctagtacagctagacagagattatggggtcctggcttatgtttgggtatagcagagatgaggtgaaataaataaggtattgatttaatcctcaagaactctactcatttaaatggacagagaaaacagatgtacatgatacattcaaaggaaaaagtgtagtactctttggtacagactaaaaactcaagagtctaatgaaggagaaatcacatacgtaagagtggtacataagagaattccttggaggcagtggttctgataacacattcattcatttcaaatgtatccaggtcctactcagtgttggggtaaggagctggtgccactgttaaacaatgggcgaaagtgacagagaacctgttacctaggagcatacagttgagtggggtcaggagaggaggttagtgacatgggtggaagaggaaatcacatcatcacaatagcaaacctctaattactatctgagctaactgggataggtgacctaaaggaaagattcctgattctagcaaagcagttagcaaaggtgcacccttgcatatatccagacatgccctactaagaaagtggcactgagctgagagtgggaaaaatgagaaacagttaatttagaagcgaagagtcttctggacaacaggagtgggcaggtcatgtagatgccccaagtgggaggcagaagtcagtgcttctggactaagggaggaccatgtgggatgggggagagaatagagtggggaaatgtagtgacagcagccagcagggagtatggggagctggagggaagagccagacactcagatctatggggaaggcattgcagtattgaaaacagcttgggtgaaggcagaaccagggtggaaaaggcttagttggagaaacaaaaggagagggtttcgtggtcaaaggcagtgagaaagaaggctgagggaatgaaccaagactctattaaaaaagatgcgtcagggttaagtggggaccatttataaacttgggacatctatggacccacagtgtagtctagactcacctttgatgttgaatttgtcagtataaacggtaataacaatcacagtagctaatttttttttttttttttttttttttttttttttttttttttgagatggagtctcgctttgtctcccaggctggagtacagtggcttcatcttggcttaccgcaacttctgcctccaggttcaggtgattctcaggccttaccctcccaagaagctgggattacaggcaccaaccaccatgcctggctattttctgtaatttttagtagagagagggtttggccatgttggccaggctggtctcaaactcctgacctcaagtgatccacctgccttggcctcccaaagtgctggggttacagtcatgagccaccgtgcccagccttagtagtagctaatctttagtgtgggatttctttatgtcaggcagtgaacttactgtggtagagggctcatgactgcttccttttcaaccctacgctgtccatctgtgaacatttccttcaaatcctacctccaaggtacatcccaagtctccgcttctgatgttttcactgcctcagccttctgagccagcatcgttcctcacctccactgcagagatggcttcctagccagacatcccaagacctagttttaccttcctccaatccattatacacatgatagacaaaattacttaaaacataaatcaactatacacccattttcatagcagcatgtttacaataaaaaagaggtggaagcaactcaaattaaatgggtatacagaatgtggtttgtctataccatggaatattattcaaccttaaaagggaaagaaagggctgggcatggaggctaatgcctgtaatcccaacactttgtgaggctaaggcaggaggattaatagaacctaggagttggaaatcaacctgggcaacataacaagaccctatctgtacaaaaaaaaaaaaaaaaaagcctggcatagtggcacacacttgtagttccagctacccccaggctgaggtgggaggatcacttgagcccaggaggtggaggctgcagtgagctgtgattgcaccactgcactccagcctggacagaaatcctgttatatgtccaacatggatgaaccttaatggcattatgctaagagagataagatagtcacaaaaagacacatacagtatgattccacttatataaagtatctaaagtagtcaaattcataaagacagaaagtagagtggtggttagccagggctagaaggaggggggaatggggaatgggggttttgttttaatgggtagagatttcagatttgcaagataaagagttctacagatgtattgtacaaaatacacttacgttcattgcatcacttttcacaatagcaaagacatggaatcaacctaaatgcccatcaatgatagactggataaagaaaatgtggtacatatacatgatggaatactatgcagccataaaaaagaaaaagatcatgtcctttgcagggacatgaatggagctggaggtcattatccttagcaaactaatgcaggagcagaaaaccaaatactgcatgttctcacttataagtgagagctaaatgatgagaacgcatggacacatagagtgaaacaacacatcctggggccttttggagggtggaaggtggaaggagggagaggatcaggaaaaataactaatgggtactagccttattacctgggtgatggaataatctgtacaacaaaaccctatgacacaagttacctatgtaacaaacctgcacttgtccccgaacataaaacttaaaacaaaaatataatgtaagtagacttaacactcctgaactgtacacttaagaattgttaagattatgtgggttttttaaccacagtaaaaaaaaattcaaaaaaccaaaaagaaaacataattcagctaatcccttaaaaccttccaaaggtgtcctactgtgcttagaaagagagaaaaaatgactgttgtctataaggtcccgtaacatctcgtctctgcttccctcaaagacgtttcctattgctgtttcttctttacttttctcttgaacttctctctctcctgcttaccgtaaaacatggcaaggtcattccatcctttgcatctgcagttacttcatcctaaaattctctacgcctaaattcacaggatgaattacttgccatatttaaggctctgtattaaatttagagaagaaatttgccatttatattaggttgatacaaaagtaatcacggtaaaactgcgcttacttttgcaccaacctacgaatcataacaaaaaaaaaaaaataaagattcttaacactgttgttatcattaatggtattcattatctgtgcctcaggttgagacctggtttctcagtactatgtgaatgtaaagtttttattttgtaggatttaattttaatggcagttaagatcacccttcttcatggcaccatacatttggatgagattttaaaatataccactgatcttgagaaaagactgattttatttcaaaggagtaaccagattttgttgtgctttcttttgtcttaagtaacccttaacctttaatgcagagaggatcttccagtaaaatcccattatctggtaaaggtatttttggggggagctggccaacagatttaaaatggaggaatttttttcctatgcggttatttgagctccttatatattctggttattaatcccttgtcagataaattggtaacgaaaatatggtacatatacacagtggactactattcagctataaaaagaatgagatcctgtcatttgcaacaacatagatggaactggaggtcatgatgctgagtgcaataagccaggcacagaaagaggaactttgcatgttcttgcttatttgtgggagctaacacttaaaataattgaactcatggagacagaaagtagaaggatggttaccagaggccaggaaggatagtgtggaaggaagaaatggggctggttcatgggaacaaaacatagttaaaaagaacgaataagtcttagtgtttgctagcaaaacagggtgactgtagtcaaaaaaaatttaagtgtacatttttaaataagtaaaagagtataatcggattgtttgcagcacaaaagattaaatgcttaaggagatggagacccatttaccctgatgtgattattaagcattgcagatctgtaccaaaatatctcatgtaactcataaatatatacacttaccatgttctcccaaacatgaaaaatataaaattttcaaaatagaaaaaactgtaggagaagtcagatttgaggagatgtaaaataaactatatccctgataatgcaggagacgctccataagtgatgggatgtttactcaaaggcaaatgtgaagttggccaaccttagacaattggccacatgcgattcagggcaggggtggtgtctgttcctgtgattgaagcagcttcatatcaggctcctgtcttcctagggatgcttatagttactgaaagcttctgactgtaacttcctctatcctgagctctttgatgggagtcagtagagaaagagaagagtggaaacatatgtatgctctcttcctcattataaagatttatttttattagcccctttgtctcatgtggctggcattgaacagccacaccggaaccattattggattctgcaagcatctctgaaagccggcttttcagtcacctcaagttgaagtgtttttgagatttgaactgcttttgttcgtggaaggtcacatgtgatgccacagaagccaactcccagtttcccgatgccgttctgctcttgttgttgatgacacgctgagtccctgacctggctaagctccctcactaagaaagatgtgattttggtcacagaggagaccaggtgagggacagcaggcacagatgacaacacattattatcattcatttgttcactgactacccaagcaattggagtctgttggattccatgtgatggagaagtcgggaggatgaaagcctgcgtatgcctccagaggctccctaccaaatgatttttaatagtctgtatccctcccacaaacacagttggttactctactgggcaatgaagtttaaaggttggagaggctccaaatctgggcacagagaaatctcagcttaattgtcccaaactattaaaaaaaagacaacaatttgttgccagtacctggcggactgctaaaggtttttgtcatttgttaagtagtgttgcacccttagtgctgcacccttaaaaaaaaaaaaaggaaaaaaaggtatgccctctttaatacttactagtggctgactcataattttaagcatgaaagacaaggagtggatttgaaatgtggtgtgtgctgcttctgtctcccacggcagcatccaatgctgtcacgagctgttaaatgatgagttctgaggggtgtatgtttaaaagcaacattgaggttgcaagcatccaggaccattgaggtagcgtggatcagaatggcttttccacgtaagagcaggcactggataaagcccagtgtgcctcctggtgttacgctgggttggtggaaaagcctctggaaaatcccaaaagagaaagatggaggagcgaagagtgtgatactctgatactcagatgtgttggtgcccccataaaaggggttcacaggaaatagggaggaataggccagtgtgctggttcactttggcttgacacatgcaaattgcctaaaatctcttctatgctttttcttagtgtctatcatgtagcagaaatgaatccctcttggtagattgagaatatcatacgcaaaatgaagacctgggaattttcctgctctgttcctaggccctggactgacatgggagaattttaaaacatgcgcttttagaatcaaaattagttttcatgtctgcagagacaaggagcccatggaaactaccaactggcattgctgagaataattattgtcaaattgagtccattgtgaatagtcctcatacataattgccctggttagaatgagcgccaaagagggagctttaatatttactaactccctggtgaagaaagaaaccttttgctttattaaaggctgtggtgatagtaatttgctgatggaatgcattagtgacatgcactatagatggattttataagaagacattgtccagaagagattattcaaattctactagtggctttcctctttgtagaagtatctagacttgaagtcacggctttcttcttttgataatatcttgattcagtaggaaaccagtgcctgtgcagctctttgtaggagtgtctatttcataaagttcagattatgtcagtatttcataacagccaggtctttccctgagacttacccctacagggataagagaacaagcaggacatggtggcttatacctgtaatccaagccctctgagaggccaaggcaggaggatcccttgagcccaggagttcaagaccagtgtatgcaacatagtaagacctctcttctctacaaataaaatgaaaaaaaaaaaggaattcgccaggcatgatggtgcatgcctgtggtcccacttacttgggttgctgaggtcgtaggattgcttgagcccaggaggttgaggctgcagtgaaccatgatcacaccactgcattccagcctgggtaacagagcaagaccctgtatcaaaaaaaaaaaaaaaaggtaagagaaaaagagatttatgcatgtatttaatgaaaaacatacattatcattagattaataaaacttcaatcaagagtgctcaaaattcaagcctcgggtaggatagggaatgcgttgcattcaggccttggacatgtttttcttggataggtcatggagttgaggggtaagcatgggacaagtccagcatcagaccaaagaagcctaatgtagagggtctggaccaagactgggtgttgctagacattacacaagagcctctttttagtcttctgcctccaatggacacccatgactgatcctaggaaatgttacacatttccagagttctcccaagaaaatgggaatatctgtgaggctttctagttcagtccccacatgctatgaggacccttgctgtcttgtgttttggagaccgtgacgtcactgtcttgtttctgtggccacaggagagtcagtcagcaggagcaagaggatggagtagtctcattgtcttagccacagccaagcctaagctttgctctaggtcaaatgatccaatgctggcccatgaaggggagtcaactgactttattttgaaggtttttaactagagagaatgtcaactctgcattggccttctatcttttgctgttacacatgaagttttgtattgggatggaaaggagaagcagaataattttgttacgaattcctacttctcatcgatgtctccttcccactgtgaaaatacaaaatagcacatcaatcaatatggcacagtattgaagaatccaagtcagccagttctagtctggcttcaaatcccagctctaccacccattcttaagtgaaatcttaggtagctctctgagcttcagcgacttcatctgtaaactcatgagagtaagaatgcctagcatattggggcttaggtaagagtaaatgagttagtgaatgctgggcacttagcacagtggttgccacgtagcaaatgcctggcaaagggactgggctgctggtagtgattctgtcagcttctcctccttgttgtctaactttgtgcttggatagcattccttatggcctcatatctacacatcaaacttttcaggggaagagagagcacattggactcatgactctgtgtaaaagtttggagaccatgaggccgggcgcggtggctcacgtctgtaatctcatcactttgggaggtcgaggcaggcggatcacctgaggtcaggagttcgagaccagcctagccaacatggtgaaaacctgtctctactaaaaatacaaaaattagctgggcagggtggcacacgcctgtaatgacagctattcgggaggccgaggcagaagaatcacttgaacttgggaggcggaggttgtagtgagccgaaatcgcaccattgcactccagcctgggggacaagagtgagacttcgtctcaaaaacaaacaaacaaacaaaaaaaaacaaagtctggaaaccatgacatcattgtcttgtttctgtggccactgcagagccaatcagttcaagcgagagggtggagtgttctcattggtttggactaggacgcataatccaatactgtcacctgagggggcgtcaggctgaaagagatccccaagtggaaaacgggctgatgggaagaacagaaatagggaaaataaagatggaggaggctcaacacatgtccactgtgctttgcaaatggcgcatgtccaccttacagagaatcaacacctcaaggcatgaactgtgttgctctgtaagtccgtagccattggtcgtcaagaatgagcttccctgtcattaggtgaacccagaagtaatcagccctaggtgtcacgttccatccagtgctctttctgcttttgagccacttactgaaaggcttatctcccatcctttggggatgctctctgcttaaaaggatgtttagaatgccatttgtagcacacacacgtacacgggcaatcctttccacttcatcttaccatattcatctgaatctggcttcccgagagtctctgtagtatggcgtggaggcttaagagcttctgtgtctttcagagggtagaaggagattcagtcgactttcttttgcccacatgaattgatgctatgctcctttaagtgccaggtttagtcccctgctgagatcacacttacctcaactaaattatttttcatttaaaagcagccatccattcacagtcttttatttgtgtttcaatgatgtttgtaaatgtgctctagcagttgaaagtgtaggcacgtatgtgggggagcattcctgatgttcccctcaccacgcatttgtgtacccctcacatgccctttgtctgtgtctcatccatctctaacatgaccacaaaaatggtgtctcctgaagtgttcaaggatctaccctcctccatagtcatgaagtttctagtaataatggtaattattcttattgtaataaggaggaaggggtggaggagaaaaaagtgatggagaaaaatggtgtctcctgaagtgttcatggatccgccctcccttgtagtcatggagtttccaataataatgataattattttaataaggaggaaggggaggaggagaaaaaagagggagagaaaaggggagaatgaggacatgaaggaggaagagaaggagttggagaatgaaaagaaaaacaagaacaaaaacaaccagagaaataacagtgtagtattagcacatctttgacacaagcttcaataatttctgaagaagtgaaggaaggaagaaaagaatggaaggaaggaaaggagagaaggagagaagaaatgggtgtatattacaggtttacttatgtgctaagtcctgtggtcagaccttgacatttcattttctcctgtaatgttcactctggctatacaagatcagtgatttcattatttgcactttctagataaggatgctgagcaaagtggcttacttttctgtattcttcctctcctgacccatccattttatgctcagctgctaggcttgtctttgtcagacacattgcttatgccagtcttctactcaaacaaccttcagaagttcccagttgagcattacgtaaaaccaaacatatgagcctgagatttagagtcctcccattttggtcctggacatatttttcttagaatctaagacataactaatatgctgtctacccactttgggtcatacccaaatggccagttacattgttcccatgtcttcccttgagagcagacatttatgaacctctgtttaaatagaataatttttttctaaagaagcctttttatggatcaaaatccttccattattctctgtgcttacagagtcttaagtctaaataatctctttaatctgcctgccttctcttattccatttctcaaaaccctcccctgctttgacttcaggctaccccatacctccactgtgctgaactaatgttagccataaacatacttgcacctgctgtttcctttacctggaacagctccttcatccgcctgaagtctctcacccaccctaatggcctcttgggtgaatttcactctatcctttaacacctagctcaaatgtcagctttgcataattttccttgactctcctagatggaatgagtctgtgaaacctgtatttttttaggtactggtactgaaatacctgaaccctgtatttagacttcctggttttattttttattttattttattttttgagacagagtcttgctctgtatcccagagcaatggtacactccaatcccggagctggagtgcaatgatagaatcttggctcactgtaacttccgccgcccaggttcaagcagttcttctgcttcagcctcccgagtagctgggattacaggcatgtgccaccatgcctggctaatacttgtatttttagtagtgacaggattttgccatgttggccaggctagtctcgaactcctgacctcaggtgagacttcttgtctttaaattttagctctgccttctatgaaatgtgtgagtttagataagctgctatctaatcctcagtttcttcatctgtaaaatggacataggcttcaaacccatatcacatagttgtaagaaataataaaaggtgatcatggaacacttagcagtattcaacagtagcactcaacagcccctgttgttaagattattttatgttcatatgtttaaaatgtctttgtttcagaggaaaaactcctcaaacataaggcttgttaattttttataaccctagcactttgtacatgaagagtgactagttcataaaacccaacactttcatggaattgaaaaatacttttttattgaataaggcattggaagacaatctgttgattgtcaagatttcagtaacatcaccaattattcgtggtgctagttgcaagtaaaatgaaaaaatgttgttttctccattctcattgtggtttggggtaacttcgattaaaatgcatatataaaccagtaatttcaccaatagttggtagagacattgcaacacaaaacctgcccaggtgtggaggatgggcatacagtggggtattatgggaatgttgcatttgaaaaagagccccagtcttggcaccttgacatcttcctgggaaaactaaccgctttcctccacaaatatgctctgggggcagagataaagtatgaggctaggtcagaagctgtgagcataaattcctactagtgtagacatcaacataatgaatgttccttttagcctctcattccaaatatagaggtggaaggcatgtccaaggttgtgacacaggatgactggcttgttgtgggccacttgtgaccaagacatttcccagtacatgctggttcctaatttaggtccttggctcgcttctgacaagccactttatggaagggcgtgatgatatatggccttcccctgctgaacagctcgcattttgacatcacccacaattctgcatattcagtttgctctaatccagacataactgttctcccttcacctttagtattcaaggttgcatcctgatccgaatacatctgtgtttggggcaaaactggagggtcgtcaattaatcttaggcatgacagtttattactccctgaagtctctctttctccttctctgctggacagagaaacagagaattcccatttctgataccagtgtctcctgtctcccagctggcttctctttggcagcacttctccacctacactgccgaagtgggagaggatgtgaggatttatattcaaggagaatttagaaatgctttgtgtttcagagagtgctttgcctgggtgtttaatcccgtgaccatcaaacccctcgagatagtacttgatggctacaataaactggcctctttcctattgtctcttcttgattacaaaccctgtcttgcacgatggtttcaaaattatcctcctgcactttctgccacatcccttcatggccaagatttttccaagttgtaaaatatttttgcttttcttccattcgttattttattttccaattcttaaaagtacataaccagagattgtatgagaaataaatgtcttataaagtctggggccttaatacttgtggtgatgataatgagatgtcgatagtagtgatgatggtgatggtaattgtgatgatggctattttgcattttggagacatgagacccactgagttaaatgatgttcttgatgcctcattgactctgaagttcttgtctgtctttgttgaactaattcaagttggagattttccttttgtttcttttcacccctaaatgtcaccattcctgcaatggatgaaaatgtggatttgttttttaggaagtctaagtggatgagattaatagcctgccctgtggtttgttaaataaacttgataaggttttattgattaccttgagggttgtctgggccaaacaccatgtaccatttaagaaacaaacattagttaagaaaagttttcatctcacttgaggaggggaaaaaattattgcaagatacgtgatccagggaaaggacaaactgagagattcatggctcaaggctttctgtgggtgtcaagttgggggtcatggggaaagaaaaagtgcaccaatcaggggccaggtgatgaccgtgtgtcatttcaattaatgtgcttctattatacagatgggcacactgagagtcagttattttgtgtagttttctctgggtcatgtagatctgattccagttcaaaatcatgctctggcacctcctgtgctgggaaaacatcctgggaaggtgaaattcagaccacttactgcctccagctcttggggcttcttgacattgtcctagtgtttgccttaagggccacccggagtaactgccctttgaattttatctatgtatgtatctgtccatccgtccgtccgtccatccatccatccatctatctctgtctgtctgtctatccatctatctatccatctgtctgtctgtctgtgtgtctgtctatctatctatctatctatctatctatctatctatctatctatctatctgtcttcctgcagaagtagcaaacgtgccccgttcttccctggagctagcaaaagcagggatagcatttggtcagagttcagccacacacttcttttctttctggcttaccaccacctagtggggccagaaaataaagggggaaatattttctcagtgggctcccaaggactgtgagaagataaacacttaattctaactactttctcccttctcggtgagaagctgccacccatcgtatgcacaaagtggaaaggcacaaagtggaaagcttgacttgccaagccagccaaatgtctctgcagtcaagatatggggggaaccgtctgtgtaatttatctctaaaatggaattggtaatacctgccctgcctaccacactgggttgagtgaagagtgggagtgctctgtgcaccagaaagggtcaaatgaaatgagaatagtcaggtgatactattgtgttgcattgtcattgcagttaatacttccttttggagaagaaatactgtacatggggatatagccctccaccttgggaaaacccagagaatattcatttctgatggaaactgtggctgggcgcagtggctcatggctgtaatcccagcactttgggaggccaactcaggaagatcacctgaggtcaagagttggagaccaacctggccaacatgacaaaaccccgtctgcactaaaaatacaaaaattagccaggcgtggtggtacatgcctgcaattccagctactcaggaggctgaggccagagaattgcttgaacccgggaggtggaggttgcagtgagctgagatcacgctactgcactgcagtctgggtgacaagaatggaactctgtctcaaaaagataatagaagaaaactctgcgagaactaccaattacccaccacctattgtatgcccggttctgtattagcaactcagtagacactttcttatttagtgtctaaggtcttcattatctccatttcataggactgagggttagcaagatgaaaggacttaaccagaactaaggcaactgatatataccagaactgtgggtttggccccatgctcttaaccacccttctgcaatgactgagcaggtgctttgggtcagtaggcatggtattaaactatcagtctgtcttccttcctgggagagacacaaaaacattgagaactcatgggcatgtttccaccgtgcaggtgctaaggtttcttatttcgtgaccagagaccaggcacattcagtgaactgcttcattcggaggtgcttggagcttcttcatggccatcctttgcaacttggagtatgcaaacaacatttcttctctaaattaaaagcttccaaagttatgatggtatgtgctttttaaagaaaggatgtattcaaaatttaaagcgatgttgaattttgatagtattgctttgtaggttgttaaattgtggctttagacaatgagttgtttatagaactacaaaatccttgtgaggaattcagatttgtctacctttcttagagggtcctaatgaggttgtgttttaagaaatgttacatagactataaaatcctaatttttaaaacaatctggttcattgtctgaagggcctcatttaacacatagtctctgtacacttggtaaaaatcataaaatgaaattattcaacgtaactgccatatcagtgggactatttgtttataagcaaaaaaacattggttctaacttgtgaaaaaaaataattcattagaaagatatgtgggcacctttagcttgaaggggagggctgaagactatctttgaaaagggcaggacccaggacagttctgcagggcctcagcagcaggaaccctgcttagtttgatccagacacccttagaacctctaagtggcttcgtttcgatcaagtgccagtcccttgatttggttataccaagccatctgcttaattaaccccacaaagcaggtataaggaggcagagggaacttccaaaaaggactttgaagtgctattgtcaatagaaagtaggcagacgttgctgagagaaaaaaatccaataaaatttctgtgaataaccagtgttggaaagagtgtagggggggaaaaaaataattgcttcgccactagagagatgtaaattggcataaattttccgaagggtaatttgtcaatttatatcaaaacctttttacaatgtttagatcctttaatcaagcaattccacgcacaggaatagcggctgacgacaatcaggcaggtgggaagcaggcttactagaggctcaaaatggtgtttttctgtaattgtgaataaatgggagaagaaaaatacctaacaatgggtattgcttaaattatagcaaatagacattatgacagggaagcctaggctgtgctactgttgctcattggtcaaggaaaaggtgcatgcacgtttttaaagaatggatatgttaatttctgaagcccaagacatccctgtctaacattccactactaattgcatttctcctcctcatttaattttaattaaacctttccttccctctctccctcccttcctcatttcttttttctcttccttcccttccctcccctcccctcccgtcccctctcctctcctctcttctcttcctctcccctctcctcccgttttatcccctccccttcgcttttccctccctccttcctctcctctcctctccttccctcgctctctttgtctttctctctttaatcttttttccttaaaacaccagcaatcacacatgttaaggccatattatgtttcaaagaaatacttgtaggctagcttaggaattctggctaattatagccttgtttggatagccagaaaacaacaacaagaaaaaaaaattgcaaaatttctgggacttgactttagatacgctttgtaaacatgatttctatctcctgtacaactgtgattcttaaagctaaatagtgaggaatcctcatgtctaaaaatggaaggcttagagttaggactaagaaatgaagtccttatcactggcccattttaatctgtgtttgggtcttgttgaattcgagctaagggaaggggaatacttcttttgcagggctcaggaattaaaagttcagctctcacttttctcaccaaggttatcgaccagcttctacaaagccaaatatttgttttctaatgaaagtgttaggagatttggcagagtaaaaacgtccttgcatctagaaaaactggcatgtgttttctttgaatcaatttccaaagattatgcagtatcttttaatggcactctggggacccacagtgtgtgtgtgtgtgtgtgtgtgtgtgtgtgtgtgtgtgtgtcttaaaaattaggatgaacattttatgtctcccaagtagataaacctctgccctacccccagtgaagagatcataaagcacaatgttattaattcagaagtgatgggagggaatgccataattccagagatgatatttgttaaaatattgatggcttaccactttcccctgttggattaatttttacccaagctggccatttatcagaaggtacataatgccatcgtattgggaagatttttttttgaaagatatttatgaagacatcaacttcagtcaatgaaattagacagttaaaagatggcaaaatatgctttggcttagcataaggaaagcaattctggatgaagctgtttctattaatttagctgacaggaaagtgtgagggtggcttgtaaagttaaatatgacctgttcagaaaccataacttgggttggcattcagtaccggggttaatactaataaccaggttaatctttaggtacagtacctaagaaacagtgaaccataagaagggatattttggtaaaggagactgaattgtgtcttcttctgcttaacccatttttatgccttccatgtgcactgataatgcaacccaaacctttgccttgacctgcaggttttgtggggtatagccccttcctgctcacaaacttctctctctagccacactctttgtttctcttccttgatcccacctaagttcattttggactcggggacttcgctttactcctggctttgggatgttgtccaggttctttaaagaaccagctccttcttatcttttaggcatcaaagaaccattgtccatcctacataagaaaactccttcctgggagtcactagcatttaatacgtttattcatatttactgctctttaaaataatcttatgtgtttgtttgaattgttcaattgcctttttctgccaactggaacgtaggtagcatggggtgactgtctttgtcctgcttactcatctctctcttctcagcatgcagaggaatatctgataaagagcaagtacttgggaaatacctgaggagggaaggaagagaagaaggaagagacagagggagggggggttagtactggcaataagttgataaagctactagccatttggacgacagaggtgtttagatggtttggtgtggggctgaggggcatcggaagctgtgattttgattgtgtctatgaacttggcaatgttaacggtcattgaacatgggtgcacattttgtccaatgcagtgaagaactctgaaggcagctccagtctttcagtggggtgtgcccatacttgatcactatcaccctatgctaactggatgactttggtacgctacttacccttttttgaccttgcctttcagtctgtattatgagtgcatctgtcaaatcagagattttcacattctcaagattttatccaatcttcaaatacatcataagtatgtttgttttaatgtcatgaattgttcaaatctgttaaagaacttcaaaattatacattcatcagaacagccacatagccccattggttgactataaaaaagcgactattacatcctcatgaaatgccacttatttagttacattttgaaggtacaggtaagattttctttgaaaaaaatgtgccttgctaccacagttttttatatttaatttttatgagtacataataggtatagatacttatgggatgcatgagacattttgatacagggatacaatgtgtaatacacacatcatggagaatggggtcttcatccctcatgcatttatcctttgtggtataaataaatccaattacactctttattttaaaatgtacaggtaagttattattgagtatagtcaccctgttgtgctatcaaacactaggtcttattcattctatttcatgtacccattaaccacccttatttcctcccccgacactacctttcccagcctctggtaaccatccctgtactctctatctccgtgagttctatcatttttatttctagatcccacagattagtgagaatatgcactgtgtgactttctgtgcctgacttatttcacttaacacaatgatctccagttcattctgtgttgttgcaaatgactgtatctcgttcctttatatggctgaatagtactccattgtgtgcataccacacttgctgtgtgcattcatctgttgatgggcacttaggttatttccagatctttttatggcagcagtgtttaccgtagttctacaaactcactttcgaagcgtgtttgtcttccatgttacctcgttagacatcaagttcctagtaaacatttaggatgagggtaagggtaccacaaggttgtgggcacagtttttgagtttgttttgtgttaaaagggcctgtggaggattgtgtttgtgttctgggactgccataacaaagtagcacagacttctctcacatttctagaggcttaaagtctgaaatcaagatgtctgctgggccatgctccctgtgagggctctaagaaggaaacctacctggcttgtccacagcctccgttggttgtcagcatccttggcattccttggtgtgtattgtcattgccccaccttcttcctccatcacctggctccttctctgtgtgtctgagtctatgtgtctccaaatctccctctctttataaggacaccattccctggatttagggcccatcctgagccagtatgacctcatcttaactaattatatcggcaaggaccctatttccaaataaggtcacttctgagtatctgggtaaacataaattttcagaggacactcttagtacagagatcttcatgttagtgggaataggctgggttactgtttgtacaggacattccctccctccacctaaattatcaacacaaaactgtaaaacagagatatttggtcaacctgtatttattgggaattgcttgcaaacatcctgaactatagtaagtgttagaaggcaaacaagaagataagaacaattctagcttgaagaactgtgtgatgtcactgaggagcaaagtggcactcagagaaccactgcagaattatcaaatcctaaacttactggggagtatgtgatgttagagtttggagaagtgcttgatgaatttgggctggtgtagttgagtacacttctcctgagcaagagcgtgagctgagccatgaagcattggtaggaccctggagacattgagaagtgatgctataaggtatcttaaaagtcaatgaagatgtttgtgctcaagtcaggagcaaatgcatgtttcactttgttggttggtgctgctataacaaaacatcacagactgggtaatttctaaagaacagaaatttatttttcattgttctggagactgggaattttcagacttgggaaatgtcacatgaaggcaccagcaggtctggtgtctggagagaaccccgtctctacttcctagatggtgtcttgttgctgtgttcactggtgggaggaacactgtgcttttaggtggtggaaaggagggaagggctgaaaaatggtcttactattgtctccagcaattttatagggtcatgaatcccattcatgagagcttttctcccataacttaagcgcttcataaaggcaattcacaactaagtttgaacacatgaattttgaagtagacacaaacattcagaccatagcacacaggaaatgcctgtgtctgctacaagcagagaaaaaaagcaagggaactaatggtggctgaatgcgggaagtaaaggtcaagtaaaaatgaccccaagatatccagtatgagattgggaaaaatggaattaaacacttggaaatggtgttctcatcacttacatgaccaggttttcattccttggatgtgcgatagggtaagaagataaagtgagtcatggaatctttacttgaaatgcaattcaataaacatccacctcaccaaaccattctttatttcaggactggatgaattaattcgagtgtttaaaaaagagggggctcaccccaatgtttctgccaccattgagtaatagagtattgggtttcctatcgtgctgttatgattgggacaagcggagccatttgtcttttgctacatgggagaggtgttaataccaagcacatccagttatgttgtgaaaggctctgttgtaattagtctgagtcgaatcatcaatcaagagattctgcaattataagcaccagtcacactacattgctgtagaaggcggtcattcatgctacagcaatacttgtctattaggtctgaggctagatgctttatacacaatatctcatttaattcttaatgaaataccctaagagggccaggcacagtggctcatgcctgtaatcccagcactttgggaggtggaggtgggcagatcacgaggtcaggaaatcaagaccatcctggctaacatggagaaaccccgtgtctactaaaaatacaaaaaattagccgggcgtggtggtgggcacctgtagtcccagctactagggaggctgaggcaggagaatggcttgaacctgggaggcagagcttgcagcgagccgagattgcactaccacactccacccttggcaacagagcgagactctgtctcaaaaaaaaaaaaaaaaaaaaaaaaaaaaaacaaccagaaaaacagaaatactctaagaggtaggtattattactatccccatggtacataaaagatataatcacagagagattaaataaatcacccaagatcacatgcctgtgcattcacagaagagaaattcaaatctggaaatccaacttaaatctgcttttaaacgttattattagccgcctcccaaaagaatttgactatatttttccattagtctctttgtacccattgcctttctttttaaattattttatttattattcaatatgttaaaaccttttaaaacattcaaaaatataaaaagggatatagggaaaaagtaagtctcctatctacctatgatctctgactccacatttccctttccagaagtaaagacgcgttaccagtttgttttgtattttttgtattgtctgtatattttcagaaatgtgatatcttaggtatatactaagaggggtgtgtatgtgtgtgtatgtgtgtgtatcctctccttccttcctcccccaacaaagtgatttctgtacaggctacttcgtccttccccccatcacttaatgtatttttggggcttgggggtgtctatgttgccagcctgtgaaacacgtggataaatattcaagttgaatgtataatttttatggatttttggttatgtttctgtctgttcactgcctcattcaggccacttgaaacacatttttgttttattatttaggaccctctaaattgtaattgcatgcacctgcaatgatgtggaaacccccttatcttgaggactggtcttgattgtgttcaaagccacatatttaaggagactggagagcctgtggtttatcctcctgagtcagagcctgaaatcgttgaccctaaacccagagtgttttgtctctcaccttgtgggcgagttaatggttgccactccgagctgctgcctctgtagggtagggacgtgtggatgcacacagcagaggctctcataaggataaaggcctccttatgcacaattcaaaagagtgaccacacccctcagtcacgattccatgctttatccactttcttcctttgttgtcccttttcccatggcatcgctgaaccgtcatttcctattcatgtttcatgctctccttacctgtgtgttgatttgcatggatttctctatgttgaatttccttctaccttacatcctttccaccctcaaagatcaacaaaatcttgtcaccttcaggaaacctttcctgattcacccaactggaatccttccctttcttttacctaaaccttgattctgttatctttgtcttcggcacttttatcctccccccataaattgccctgctcatagtagttgctcaataaatatttgatgccaatcccatggaaataccagcatatgtgtgcatgcccttcaactctcagagacaattagacttccacttcccaaacttaggatgcctcactcattagagaattgacaagctgcctaactgtttgcacagtctccaacacattataaatatttggataagtccaccatcaatgcacagtcattgcagagccaataaaacatgaccttgactttctcctgtttgtttacatgcaccctacagcatcatctccaaaggcaacaggagcaaatggtgaacagctgggcaaaggaggtgtccttcacacgtcctatatttggaactggtggaaatagccagtatgattctgtgtcagtttaacaggatagatacgattttaaaatgacatcttcattgtgaaccagctgtgggcaggggctcatcttgatatcacttgtgctaggctttgagtagggcagagtttctcaaccactccagtattgatatttgggaccagatacttcttggttcaggggagctgtcctgtacactctacgatggttagcagcaccttgcttcaacccactaggtgacagtagcattccacaccccacctcccatccaaggccaggttgtgccaaacaaaaatgtctccaggcattcccaaatgtctcctggtggaagaaattggtgtaggggccagaggaatatttattaaatgaacaggtaaaattatccatgtttgaacattatcaatttctatttctctacatgaagaacaattaatcctccttggcaggtgtgcaagagaaacgcattttactcaatacctaattaattggttaaaaaacaaaaaaacttcttgtaaaccgcccccaaattctagctgccaccttgttatactccgaaatgtggtgaatttgtgcctccatctgttacccaatctatataacttgacatttgctaaaaagtaccctattaaagagggttgtttttattgtaaactacttttcaaataaaagcatattgcattgactgtaagttctactatgcataaaaaataatttaccctgtccaggcacggtggctcatgcctgtaatcccagcagtttgggaggtggaggcaggcagatcaagttcagaaggtggagaccagcctgaccaacttggtgataccccatctctactaaaaatacaaaaatcagttgggtgtggtggcacacacctgtaatcccggctacttgggagactgaagcaggaaaatcgcttgaacctagcaggcagaggttgcagtaagtcgacattgcaccactgcactgcagcctgggtgacagagactccatctcaaataataataataattattattaataatatattattatttatcctaaatgtaacattgagtcagctgttttcactgatagcacagctatggtatgaagtaagatactacaggtatattgaaataagaaccattagtgatttattgctaaataattgcatagactccacaacacgtacggaagaaggtgtttaaagttctacaaaacgccaagttgtagtaacacttgagaatctgaactgcatgtcttgttgatatttctttaacatttttattaaatattatccctagtttattgaacagagtcagctcagtgagatataaacatgaggtgactttttctccactcactgctcccaaattcagaattgcatattcttccccttcccctagaaataactcagatttttcaactttctggtcccttttggttattagatatagtctcaatgggtatttatgtctctgtcattttctctttcaaagtagctattttacaatgtgtttaaagtttcttttcttcccttgtcagtcagacttgtagcttccgaaaaggagacagtgtgtggtgtttttctttcctccccttcttttatcttagaatgaagagggaggattttgtatgactttggagcattttttcctttcttcttccggccctctagatctgatggagtttgggggcaggaagaagcggcaaagagtcatagctctcaagctcaacagtgtgcttgcattcctcttatttggcatggtaagcatgagtgagtttactgtcactcacatagttccagcagaaacagctgagcttgagccagtttggtgctacattccaagaggctcacctgcaagatggggagacagtgggctgtagcaacattgttgctatttgtctggtttctttgttgtaaatattcaaattctttctttctcacgatgcataactatcacagatacctcaaatagacatgcaggggcttctttgctccttgtattagtctattttcacgctgctgataaagacatacctgaaactgggtaatttacaaagaaaaagagattgaatggattcacaattccacatggctggggaggcctcacaatcatggtggaaggaggagcaagttatgtcttacatagatggtggcaggtgaagagagagagcttctgcaggggaactcccttttataaaccgtcccttccccacccccatctcatgagacttattcactatcactaaaacagcacgggaaacacctgcccccatgattcaattaccttccaccggatccctcctacaacatgtgggaattgtaagagatataattcaagatgagatttgcatagggtcacagccaaaccatatcactcctgtttcttgatttggaagatccggctccagaaaaaccccaatcacctcccttcctggtgtctgttccaaccatgcatcgcacaggccattgtcccccaccttgcaggtgagcctcttgaaatgtactagcaaactggcccaagctcagctatttctactggaactgcatgagtgacagtcaagtcacttgtgcttaccatgcccagtagtaggatccaggttgtttccctgcttcccttattcccactctgcccccggtttttcccaaattctatttttctccagcgctcagggacatctctgagacagccatcaagtttgctgtgtctgtagacttctaactggggaaagacatttcaacctccccttgttgcaggagcctctggtatttgcaggtacttcacttagcatggactcatggctttgtgggtgagctgaggagcaggtaccagagctctcagacataggatcagttttcttaagacatcttactcgttgctagattgttcctaagacctatggatgtcctgattatgattacatttaggacaggttctcatgaacgtgggaaaatggtgaaatatttttacttttcatagtttttaattttaatatcattggcttttggaaaatacctattgttttaaaacagctacctagggtttcaataaaagtggccttaatgttctattcctcagtgtacgaatgacccattctcggagcatatgttgtctagtagcccttgtcctgcctttctaggagatagagtttctcatggacccaaacagggcttcttaatggagatttataacatcaaaagggattacatgagaacaaagtaattatccttcgtgtatgagtatcaacccaatttacgaaggagtgaaattagacactgcagttaattacagggacagtctcaactttgtggaccaattagggctcattggttgcaagcaacaggaaccaattccccttctacattaagcaaaaagaatacttattagcagtagtcagtgagcttacaaaatttagaggtagttgaaaaagcagtgttggtagcatgacaggcaccaagccactgtgaggtctcctccatgggaagaaatgaattccaactaagtcttccgtccatgtatcattctgctccagttctggatcccagaagagcacatcccattggccagacttaggcaatacctccccttcttgagctcaccctggctgggagagctaagatgtcaaagaaagttcctttaggaaactctttatcttccagagtgggaaggcaaagtacccaatgtatggtcttacaaaggctgcataaaatgggggagctgtaacttctcttgggtactcttaggaaaaggaagcaccaaccagtgagcaagtgatctccattcccttttcatagagaaggtcgatttctatcctcttgcctggagggtttcagagctgccctaggctgtactccactccagggtggccctcagagaccattactgtttcctcatttcttgaatgtatggaggaccctccagttactttctgctttaaggcgatgtttattaaacattgtttctattagggctgtgctccttcctctgtaccctttaaatattcatctccctcatgctgccatccccttcatggagatcattcctgcagagcggtagtccagtttgctctacttcctggtgatcgtctcttctcgagatttcttcctgcacatgcacactctggactgtgcacttttctgctctggattcctctcctggacagttgcactggactccattcccatttgtctgagcttagggtttatgtctttttagggcatttaccgtccccactcctgtgttaccgtctctctgtgctcctagcatgtacacattgtggaatgtgagaaggcaaagatctcagactttccatgtgaattgaagacccttctctggccccttgagtgccagtgtcaccaacaccactggtcactctcctctcactttctacctgtacaaaggacagtctcccagtgtccctgtggaacattgtgattactcgaagttgtcctagctacttgggaatgagtcctaagaagattcatcttacttctgatgcatcacatgctctgtgttgcaaagcacacttggcatagccaggagcatcctaggttggcctagtgctagatggcaggcattgaaaactgtcaacaccagtacaggaacaggaaagacaaaccatggaactagatgagaccctgatactgagttgtggacagatcaactatagtgatacaggattcttgattgtctgcaacagagaacttttctaagtaacctatgcacatgataatttgatttgaatgcttttggggagaatgcagtatcatcaggaaaatttgagaacctggctcagaaaatagacaaaagggatgaaggtaccattaggatccctgggtagaaactccctgctaaggatgctgttaccagcactgtgatcactgccacgtggcaccaccagcatccatagtcctgaacacagagcagtggttctggactctacacttgacacagcctccagggatggtgcttgattgatcctgtgcttttacctagccccttaagacccaagacatatggtaacatacagagtcaagtgattttttttttttccttgaaaaagcaccagtgcaatttgaggaggaaaagcaagtcttttcaacaaataatcctggacctactggatgctggaatggaaacatttaactcagatccatgttttccatcgtagacacaaattaactgaagataggttgcagacctgactacaaaagcaaacactcgaaagcccctggaagggaacataaacatctgcctttgaaaactgagcatggtcaacattttcccagataaaacacagtacgtactaaacataaaagagaagtttgacagacttcctcaaaattaaaaactttgtcccataaaaagacattaagagaatgaaaagtcaagctgcaaggaggaaatataacaatgtatattatatatatgtgtgtatatatacacacacacatacacacatatacatacatacacaaagagctgtggctctggacttaaatattttatcaagagaaatgaaaacatatctgcacataaggcttcttcagagatgctcattgcatgtttatttgcaatggcaaaagaagaaaaaagggaaattacccaaacatccatcaataaatgaatgcataagtaagttgtatagtcactcaatgaaatgctatccagcaataaaaagaaatgaattgctgacaaggacatcagtgtgtatgtgtgtgtgtgtgtgtgtgtgcatatgcgtatgtgtataacatactcagcaagagaagttatccaccaaagagtccatgctttatggttctagttttatgaagctgacgaacaggagaaattggcctatggggatggaattcaggatagtgattgtctttcacccgctaagatgcctcttcagtttctacccaaagacttcatatatatttacctctaggctgtccacaaaatggagatgtgtgaatcatgcttttcatgccattgggaaaggacatcctgttcacagcagaggtgatacaggagcattaatcaccaaatgtttagtaaatattgatacccgggtgatttacactaatcgtcacaagaccgcaatctaccttttatataaatgcaataaaaaaatcttggttataaaagtacttgcttcctttgcattttttctgctgggggagaagcacagaatgcaaagagggagaagggaattttctaaggagatggcatttctatgcactttgactggggtactggttcatgtatatgtgtgtgttggcaaaacaccatggaactgtatacttaagatctgtgcagttcatgtaattacacatgaatgaccatgaaaagtccaatgaggcatatcctagtggtcaagcctggtcatatgtgcgcattcaacatacagaaaacttgtttggtttctgtagcaggaggtatgagctttctgcaaatacaaatggtatttgaaggaaggacagtcattcatgacacaggtctgctacagcattggattccgcatcctgcagcaaaagccaggttgggaccatggttgggatgagattccatgggaacaagccaggagtgaacaactgcagttagagtggaaaacgtgtgctggtttgtctgggactttttctgtgtgagcactcaaagtctcatgtcctgggaaaatcctctgttctaagccaactgggagagttggtcaccttctttccagccagagctctgtctaaagttacatctgatggagaaattgagggatcacactggaaaaagtgaacccagagatttactttgaagctcctctgggtatgaggtcagtgtgggataattgtcatggacgaagattcactagaagtctcacaagccctgccaccctaaatcacatcagaaaagaacccctatgcattttcttttcataccacccaacatcctaaaaccatcagcttagtgttttcactcccattccctataaactccatgtggtttgttcacatgtcaggtttattcgtcagtgtatctttagcacatgtaaatggctgtcacaaatgcttaaatgattcagtgaatgattgaatgattcaatgaatgatcccatccatcaaccgttgctccaggcttcttgtaaagaccaggatcctgacccatggacatttttgaggctttaagccacagcccttcgagcaagggctggaaggaagcctctttcatctttctctggggctatcacaaccagcatatgtgtatttaattagtcactgcctatttttatatgttacacaagctcagtttctccctctctgttctctttttctcaatagtggcaatgtagattttttaaagtttatttttcagtttcttcccttttcctgcagtctccctctagagatgacactgactttaaactttgacccactaagatgcctctttagtttctatccaacgacttcatatatatctatctctaggctatccacaaaatggagatgtgtgattcatgcttttcatgcctttgggaatggacatcttgttcatagcagaggtgatacaggagtattaattaccaatgcttagtaagtattgatacccaggtgatttacacaaatcatcacaagaccacaatcatcacaagactacagtctacctcttgtataaatgcaacccaaaaatcttgaattataaacttacttgcttccttggacttcagataaatctctagtatcctcaagagtctttgaatactttcctgtctccagcaaatctcgtgggaaggaaaaaaatagatatcactttgcaatttatgtttttaccagcatgcaattgagtagattcaattgactccaaatgttttgcacattctaatttctgtcccctattgtcctcccctgttgacttcaagttaatgcataatatgatatgggacatccctcataaattccgtatcatcagagtaatgtggctttgatgatgtactgcattttaaattagctctgtcacaaaaggacgatggggggcccaggaggttttttttttctttctaattttccttctgttcttgaagtgtgataagtctaattatagttggcagcaaacagaagtgtttcttcagctagtatggcttgtgagggttcttggattgctatgatatcttcagatttttatagtaggtgtcttagacccaacaagtcaagatggcttctaagtggaaaggttttaaaagattaaagagagattaacaatacaagaagttagtaacattgatctgtcatggccaagttcagtggtgcattcctgtggcttattttactcatgggaattaaataatgataacattttcagaatcttagaataatttggagaagaggatatgacatatctaaattatgtgtatacaaagtaatttttgtttcttctaatactctactagtctaaggggattccttcctatccattgtcttttctggggaaagaaaccaaatgtacagtcctacgtacggtaggaagaatagctatagctcctctcagctctggtataggaaacatgctctaatgaattttccttccagcgttccataccagtgtttctcaagcttttagtgagcacagggatctttccaggaatcttcctacaatgcatattctgtttcgtaggtctgggtggagcctgagattcggcacttctaataagcttccaggtgttgttcctgatgccggttcgtgcaccagaatatgaacagcaatattttatagggtgttaagcaacagaaatgtatttgtacgtggatgtctctgcaatagaattgcatccagaggagaaatgaaatagcttacaattatggatgaattgtgtaggtattcatatagaatagctaacataaatggagccatgcgtgtattatttaacactcacaacagtatagatagacacagtgcttatctccatgacagagttgaggggctataagcttacagatgtttagtgatgtgatcgagttgctgagctaacactcagtggagtttgaacccaggcagtatgatttcagagaccacgctgaagtatctgtactgctcatggactgttgccctgaaatgcagtttatttgtctgaagtgtaatgtctggagttttttgcatcttcatcattataaacctcttacaaatattaattgagttccttaggccattccttaaggttttatagcagataagagaagataatgtggttccaactgaagaccaccaaatagtgctcactggtagctgaaattcaggaaatgatttacatatccagcaggagtgattttctttatatatagaaaaatatatttaaattgagttaaatcattatctgtagtaattatagctgaatggaagaaccggcctaaagagcaagatttttttttttaataaaaaggatatcctaggaactctacagtgatttgcagattaattctatctttgtttatatttctactttcaaacttttttattcaggtaaaattcacataatataaaatacagatacataatataaaattatataaatataaaattatgtgaattgtaaactgtacaattcaaggacattagattcacaatgctgtgcaatgattacctccaataagcatgtggaaatatgctcaacaccattagtcattagagaaatgcaaatcaggccaggcatggaggctcatacctgtaatcccagtacttgggaggccaaggcaggaagagtccttgaacacaagagttttataccagcctgggcagcacagggagacctcatctctacagaaaataaaaataaattagctgagtgtggtggcacacatctgtggtcccagctacttgggtggctgaggtgggaggatcacttgagcctgtgaggccgaggctgcagtgagtggtgattgcgctactgcactctagcctgggcaacagagcaaatctgtatctcaaaacaaaaaagcaaaaaatgcatatgaaaatcatgaggagacatcatgccacacccactaggatgacaagtaataataatagtaataacagaaggtaacaaatgttgtccaggctgtggagaaactgaaattctcaaatattgctggttggattgcagaatggcacacctgctgtagaaaacggtttgggagttaaaccaaggtaaacacagaattctcactaacttttgacgactgaatgtgtttgcctttttccagctgttggttgttttttttcatggcttcttccagggcctctgtcttgtttgctaatatgcggttctttgtcctgtatccattcagtagccaatgtaaaatggtgccaaacttactattttagattgaagggattagctcctctttccagtgattttaccattgtctgttcttagctggtgccaggttggaaagggaagagttgttggctggtttgttggtgtttttacctccaggtactgtgtcattccaatgttatttttactgtctcatgtggagtgtcctatatgatttgaataaaagtcccactccattgctgtctctgcaaggctgactcctttgaccctggcagaaagaacagttgatgatatttggtgaaaaaaaaaaagaaaatttgcccatggtatgactgttcttctccttggcgggaaacttctacttgaatcattgtgcagtatgatggaggcacttataggtttaaaccctaattatgccacttggtagtgtgtataagcatgggcaggtccttcaatttccttgtgcctctgttttcccaaataaatcatggaatagtacttacagaaatggctaatgattaaataagataatgcaggaaagcatttagcgtagcatctggcacacagcagcactccacatcaacgctggctgttattgtattattatcatggttacttctgtcctagtttttactctattacatagtttgggtctatttgcacaatatacttctttaaaacacacacgtacagtcaggtgcagtggctcacacctataatcccagcacattgggaggctgaggcaggcagatcacctaaggtcgggagttcaagaccagcctgccctacatggtggaaccccatctctactaaaaatacaaaaattagccatgcctggtggccagcacctgtagtcccagctccacgggaggctgaggcaggagaattgcttgaacctgggaaatggaggttgcagtgagctgagatcgtgccactgcactccagcctaggcggcagactgaggctgcatctcaaaacacagacacacacacacacacacacacacacacacagactttagaattatctcattgtcttcctacaagctgtctttttgcttctgcatgaacttttaaaccttctccaccaaggcaaggtaactttaaatggttttccccacagatagccagccaatgaaaaaattaccaatgtcttaacagaaaggaactttgttactttcaggtatacacagcaaccctgcagttcaacagtctctgtcctgggtagggcctcacgtgacttgactttgatgaaatagagaagcaggctgccctctgtcagttgaagaacccatgtttttagcataatgacctgattctgtatgtggcttggggaatcctatttgtgaatctgaggtctatctttatgttaatgattcttcattactttaacattcttgaaagtaggttttggccttagaatttgtgcaattctccctcaattgttctttattcgtagatagccatcatataagctggctggctgtaaaaaaaaaaaactcaactcaggcctagcgtggtggctcacacttgtaatcccagcactttgggaggctgagctgggtgggttacaaggtcaggagatcgagactatcctggccaacatggtaaaaccccatctctactaaaaatacaaaaattagccaggtgtggtggcatgcgcatgtagtcctagctactcaggaggctgaggcaggaaaatcgcttgaacctgggaggccgaggttgcagtgagccgagattgcaccactgtactccagtctgggcaacagagcgagactctgtctcaaaaaaaaaaaaaaaaaaaaaaaaaaacctcaagtcagtctctgtacagacgtttcaagaatgcctaatctgtggtgtctgtgttgacaaattcttatacaatgctttaaacatattcagattttaaattttattaacttacctaattattcacttaaagtaactctttaaaaagactggcttatcttactctagctgtacttttttttgctagtgaaactaccagtggattactttatctcagattgtattcatcatatttctccattataaatccgttaaaatgtcgtttctctgacttcttggagttgaggtctgggattatctgctatcagaggaaattcctgccagaaccccctagacatttccacattgcaaagcagcacgaagagcaagcatgagtgaatcaagttcttatataaagagggatcctaggataatgctacttttagagatggaaaagctctaagatatttccaagtaaaagaaacctgtgtttcagagagggaaaataacctgagtgttcacagtgagttggtagtaggacacagatgagaactctttcattctatgcggtaatggctctaggtcctcctgtcttaggctctgaagggagacagactgtagtctctcctggaatagcccgggaaggaactttgacatgaagatattcaacctcccaatggtagaaataggtgactctggcattcattcattcatgtaacaagtatttatggagcacttacccaatgccagacactgttctaaacagaggttatggcagtgagcagcactggacagttccctgctcacatggagttggtcacagtgcagggatcagacagtgaataggtaagtcagtgatctgccgagaaagatgacaacagtgtcacatcagggtgacgtagtagtacctgagatagggcatagtgaatggaatattttttctaagcgcaatggaaagtcactgtagagttttaaatagaggagggataggatatgacttatgttttaaaaatctcagtgacacctaggtggaaatttaattgtaggaagagcaagaatatcaattctgggcaaatgctgtaggtcagagatgatggtagctgctaagatagtagctgtgggcaggagctaatgatagaggaaggatactggacataaatatgaggactagaccctagacttagtggaagaggtgagcgaaaaagacttacaaacaactttaatggttcagcttgagcatctgaacagattaacccaaagagtttacatcaggctctgtgcagcaggtagtgttcactgctttagtgttcattgatttacatctccccctttttttttttaattaaagagattaggtctcactctgtcacccttgctggagtgcagtagaatgatcatagctcactgcagcctcaaacctcccatctcagcctcccgagtagctgggactacaggtgtgcaccatcacacagagataacttttttttctttagagacaggctattgctatgttgcccagcctcgtctcaaactcctggcctcaagtgatcttcctgcgtctgcctctcaaagtgctgggattacaggtgtgagctactttgccccaccaacatctattttaaaaataatcttgagatctataagccattcctgaccagaggtcagatacttatctgtttcttttctctttcttgagtagcacctcacacagggctggattgtggggtgttctaaatgcaggggtgaggcaggtgtactggagggttttaccccatgtgtgctttcctctgagctcaacaactgcagctaagaaaggtgtctcagtggataatcgcatgatccactgccctgtgtgggaccatagtcttttttttttttttttttttttttgagcaggagtcttgctctgtcacccaggctggagtgcagtggccttttctcggctcactgcaagctccgcctcctgggttcacgccattctcctgcctcagcctggcaagtagctgggaccacaggcgcccgccaccatgcctggcggctaattttttgtatttttagtagagacggggtttcactgtgttagccaggatggtgttgatctcctgacctcgtgatctgcctgcctcggcccccagaagtgctgggattacaggtgtgaaccactgcgcccggccgggaccacagtcttaagacgctggctctgccttcctgggtgccacagttaccatcttttgtaagtctgtaaacttcattggcctggcattgacttcctctgggtacattagtggggaccacaccgtgctgagtcacagttagaaggggcgtctgtcttcacagtgcggcatcactcttatcctggatgccctactctttatcattcctcctcctctcactctccctccccagggccacactatcgtttggcagtaatcacatccaagccaattttgatcaatagttttgttcatttcaaatggaaataagctccgtgtttagcagataaggagagttacactcaaaatgtggcacatttgtaccccatcccttaggtggaacatggcaggattcttcaggagggaagaggatgcactaggcttaatgtttaacattctttggatggcgtctcctccatgccaccgttagctgtgagctcagcaactctgggaattggaacagttgcccctccttgagactctttactgcttgtgacttgacacaatggaagggcagatttccactgagtctctactcggtggcttctcaaagacttccactgagactctgcgcacctttattgggttggcctgattcaagcctgcttgcagaggcattttctttcttgactctgacatgtggctcagtttgggaacccacttgttccctctctgagatctttccgcctgcattttgggctttgcgctttttataccttactgtggctccaagaaggcctttactgctgctttgggttgttttgctgttgttttgttttccacttagatgccctcccggtctggaagatttttgcctggttggaaagaggcaccttggcaggggaggagagaggagaacctacgggattatgtggaagtctttccccgaggttcacaccgaagcatcttagaagggttagaatctctttctaaacacttagtaagacacgttttctgaagtgtcactacagagtctaccctggcagaagaagccacatctttccagatacacctgcatgaaaaaaaccaaaagaagaagaaggggaacccaggaaggataacacgagatagaaaggccatcttggcatttggggaataaaaagtataagggcattttgcttttaaatctaagaaaggtataaagaggagaaatgttgaaaagcaccttgtctctggtttcttatgtttgccaaatattagcaagtacctgagatgctcttctaggtgtctgtcttgtgtgccatctggcccatgagctgtttgagatgggagagtatcttatctgtctttgcatccccagcaccagtagattgaaccgagtaacttccacggtgctcatcccaggggcaacaggccctgttgaacaggcattcactttatggtacttggaccacacttggtggggaaagaggtacttcttggccaccacaggtgtggttgcaagaaattagcctcataactttgaatggattcaaatcaagcatatctagagcatagcagaagtgtcatcaatggtggaaaaccaccttttcccctcttgcaatctgaggaacacctggcaaacatttccacctaaattagttcttggcttcactggtccagcttagttgaacggatgttctgggaggcactgtaatttcctgttttgtaggatctcataggaaatttttcatgtgaattcaactctgatctcttcattattgattatatgcaactcttggtattgttttctcttagcattcgatcgtattgattcaaatgctgttttcattaacttcatgggtgcatataagagactggatggatttgaggatcataacttcagtttcgctgactgcgtatccaccccatactaactgtgggactctatataagtttgtcttttcaaacctcagtttccttgtttgtcacatggagatgataacactcctctctcaaagatattgtgaaaattgaatgatgctgagcacgtagattagtcagcgaagggtacccacgaccagtgatattatgatggggcttgatccaagttggaatccgttacctttgcccagtaccattgtttgcacatgtctgctttttatgattattagttaagagtttattttcttacagaggattaggcaaagggtgattaagcataggttattcagtttaaactaataaatcttttttttataggctgaccatctgtcagggaagtggcagaaggcattccaataggactgagttgaattaaattgggagataaaagtaataacaatggctttcctccaaatgatatctaaaaatccgcgtactttttccctagcgccatttttgccactttaatccaaactacccgcatctggactacaagcctcctaactggtctccctcttttccttgccttcagatccaatctttttgtaataggttgatccttttaatattcaaaacaggttacctttccccatcttttccccctcctggccttcaataaaaacccaaacgtaaaataaaaacggataacttggcctgtaatcccagtttcatctggcctcttgcctttctctccaacccctctctctctttctctccaggccatcattcttagggctttcaacaccctgtcctccatgtcatttctgttgcagccttggagacgtgtgcctctccttctgccagaggatgcctcctgtcgtggtcacttggcaaggtccactcttatgtcacatctcggtttagactctgcagaaacgcaattcccaacccctccgataactactctccaccccaaagatctcactgtactaattgcagatttattgatgtggtgcttgttaagttactcaccatggtgtccccagaacccatgttagtggcattgctgaataaaaggtgcttcaaactacgaagggcttataatgtgcattttcccacttgaggctgatggcatctttgtgaggaaggcatatagtggacagcctcaaagctataggagagtaatctaaagcccactctggtgaaaacttggaaatgttaagaatagggtttgaatcccaggtgtctgatgccaggcctaaagctctttcaacttgagtactgcacgtgctagatagtctctgtgtactgttgtctaaaacagggatttgcaatcttttggcttctctgggccactttggaagaagaagaattgtcttgggctctaaataaaatacacaaacactaacaatagctgatgaactattaaaaaatcacagaaaaagattataatgttttaagaaagtttatgaatttgtgttaggctacattcaaaggcatcttgggccacatgtgacctgtgggccatgggttggacaagcttggcctaaaaacgtattgtttgtctaggtagggtcatgattcatgaagctattgagcaagcattttcatggcactcatatcgcctgtcagactttgtcccaagtgcattgtaagctcttccttgcctaatctgcacaaagaccttgtaagatagggtattagttagtatcacaaactgggtggctaaaaatgacagacatttattgcctcaccattctgggccaaggagcccaaagtcagggtgtcagctgggtcatgctccctctgaaacctgtaagggaattctgccttgcttcttttgactcctggagtaatggcactctctggcatattgtgattggcagctccatagcacctctgtctgcttctactttcatgtggcattctccctggctcttttcacatcatcttccttctgtctgtgtctgtctttgtgtccacatttctccttcttataaggacacatccaccttactgacctcatcttaatttgattcctttctgtagattctttttgcaaacaaggtcacattaccaggtacctgaggttaagggtttatctgtctttttgaggggacatgatttaacccctagcggatacatatcctattccattttcacaaatggggtcataggctccataataggaccaaagattctgagcttgccattggcaatgacaagttcaaacacagatcatgcctccgaagtccatgcttggtttgtggaccacacagttttcaaacccttaaatcaaagtgtggtccgtagattcaattaactttcaaaaagtgaagtagggctctttttcttgactcaaagtgagcttagccaggagaggcagatttttaaagtgcctgagcatgcgtattattactagctttgcctgctgaagcagaaatgtgttcttcccctgcccaactctattgcattgagaataaagtatctggcgctcttttactaagatgcaagccattcttcattttaattggtggggaaacgtttattataaaatgctcttcccccagaatagttccctaaagtggcatatagtatctgttttttcttcctcctctttcttcctgggaatcattaccagccccggctggtgatttataatcacattcccaacaaatttcactgttgttaatgactacttattttctatacaaatgatttttgctctccttcctgaggataattaactaagaaactggtaataaattactgataatgatcagtttgtcagagatgattgtcgaatggtgccatcttccatagtaactagataaagtatctttaattgctgataacagaacagacaaattgtggttcttttttttgttgttgttgttattgagatattcatgaaatcttcctcctggaagtcaggcagaataacaccttttttctctgtctcctgagggaggggaaaaggaagaaacagtcatgacttacagacttctagaaatatagtaaatgtgatcgctttttgaggtttgtaataagatagctgatctttgtaaagcagagatcagagaaaatctactctgggatacatttcgtttagaccaggggtccttcctggtcatgtgtgatttttttttttctctcaaaatgtcatctttcctatttgcatctaaaccttggccttcaaatgtgacttctttgaactctggaaaggaatagtatttaattcacagtgtttctcacggttaggatgctgactaaaccccagactgcaagcgaggctgtgaaagacccttagctgggaaacgtagagaagacctatgacaatggatgtacactgaaagtcctttaatcatagcccttattatctattttcttattgacaagctcagactattcatcgtagtaagaattgcaggacctactattaacttcagttctttgaaggatacacatatttcacatactgaaggctggtttacatttaatccagttaaatgtgtcactttactgacatgccttgaatattgtgagtcttgggtattgccatcctttatttataatctccatcagtcttgtaaacttttgttttgttttgctagatgtcagcaactgtcaaaaaagctatagtgtccgagatcatttgaatcattttggcagtttagaaaacagagtggtgcttaaaagaatagaaatgagaattccaaaggcggaggtctcaatatcaaattgttggggggtatgtagtgtctctttgggctttttaggttttgttatgagaagggaaggcacaaccagcatagaattagaatgtacaaggttacaaggatgtttacacactgatttcttcagaatttcttcagttccaagtgaaaaaagaaatttttttaagtttcaagtaagctctccaggtagtcacagggatgacaaagatacaaataaaacacgaataaactttcaaataagctgaaggaaaaaagaattaaattatagaactgggaagcacacggggtagacttcaggcgcggttgagtcagaagatttcacgatgtcgcaagaactctgattctctcagatctgcttcctctcttggtaccaggcatcgttaggtttcttccacacgtagtcttcgagaagttagcatccttggctgggtgcagtggcttgcgcctgtaatcctagcactttgggaggccaaggtgtgtggatcacttgaggtcaggagttggagaccagcctggccaacatggcgaaaccccatctctactaaaagtacaaaaattagctgggcatggtggcggcgcctgtaatcccaggtactcaagtggctgaggcaggagattcacttgaaccctggaggtggaggttgcagtgagctgagatcatgccactgcactccagcctgggcaacagagcaagactctgtccccaaaaaagggaggagggaagaggaggcggggaggaaagagaaggaagaggggaggaaggaggaggaggagggaaggaggagggggggggaaggaggaggaggggaggtgggaggaggaggaggggaaaagggaggaggaggggaggagggaggaagaggggaggagggagtaggaggagggaggaggaggagaggagggaggaggaggagggaggagtaggagggaggagggaaaaggaggaggggaggagggaggaggaggggtggaggaggaggggaggagggaaggaggaggaggggaaaaaggaggggacgagggagggaggaggaggagggaggaggaggaggaggggaggagggaggaggaggagggaggagggaaaaggaagtggggaggagggaggaggaggggaagaggaagaggaggaggggaagaggaggaggagaggagggaggaggaggaggggaggaggaggatgggaggaggggaggaagggaggaaggaggaggaaagcattcacttgaagatactgcagcaaattgtagggaaggctttgattggctaatttgagtcatgtgcctacttctgagcaaatccctagacgatagggctggagtcttctgagtggctggtctccagcctcatgacctacagagtaaggtaagaatgaggggaatacagctctgactaaatgaaataggcagatgtagaatggggcaagggtggttttccaaagtaaaagattttaggtcgatcctaaaacaaaaggaaacacaagcacacagtagtagagagaccttctcatggacccttacgtactttgactactacccagctcagtttgctctgcttaccagttcacagatgctttctttggctggctttgcttttacagtggattttctgacactttttgaacattgtctaagaggggtgacagtttcaaatccacccaagaagtggacaccattccatactttatgactgaatctaaaatgctgttcacttgtgcctccagctgaaacatttttctcttcgctctgtttggagtccctctccctcccctctctctatctctcactgttcttcatggtacacttcttttttgggggttggcggggggacagagtcttactctgtcgcccagactggagtgtagtggcgtgatctcagctcactgcaacctccgcctcccaggttcaacaattctcttgcctcaaccttccaaacagctgggtctacaggtgtgtgccaccaggcccagctaatttttatattttcattacagacaagccttcaccatgttgaccaggctggtctccagttcatggcctccaattcgtggcctcaagtgatctgttcacctaggcctcccaaagtgctgggattataggcgtctgccaccatgcccacctaattttcgtgttttcagtagagacggggtttcatgatgttgaccaagctggtgttggactcctgacctcaagtgatgcacctgcctcagcctcccaaagtgctgggattacaggcatgtgccactgtgcccagccttcatggcacacttctaattctttccttcttcatgagctttttccagcatgagccaaaatcaatttcttcttctgcatccccactgaaattgttatacttcataaaatactttgtacctacttcagttttagtttctaagaatttatgtctttcttgagaaacagagtactgttttgtgattcttgcttcggcacttcacattgattagaacaatgcctggccctaaatagatatttaattctggtgagttcttcccagacaagtctaaaggagggtgtgaatactcgggcaactcaagttatcatcatttgggtctggctgtgttcacttatgggaatacaagtgtgggcattaatagtttggaggagcacaggagaacagtgagctgactgcagaggaggagatggattttgtttctcttgggggccccaggaattttgcctcctggacccattttatgtgataatggctctgcgttttgggttacagagctcaactctctgagattaacacaaagcaaagggcttccctgtatgtctatatagatctagcccaactcaggataagcagcttctcactaattcagcaaatgttgtgtagcatcagctatgtgttggacacatgtaatgagtaaatacatatgtgactgctgccctcatggttggagctttgctactgggatggtctagtctggggctgcctcttattaccagcggcatctcagactagttattcaacaactgtgtgcctaaattttcctgcctgtaaaatgggaataaagagatacttcacagagctattgtgaaaactaaaggatcgtataattttacgctgtctaacataagtaaccatttagcaaatgacagctattacttgtagctattggctcatgaagtctgcaggctggtagcacacacattcatcaagtgataatatttaaaatgtaaattatgacataattgatctgaaggggaggtgcttggtgttaagaacacttaaaataaggaattctgtaaaagcttgcctgggaatgtgtagctaatatagctacagataagactattaaaagattagagccaaaatgaataatgtatccatgtctgatgattgataataaggcagcagttgtggacagctgagatggtccttttccaaccgggacgtcagagctactgtgattatcatgccaattacatctcacattctgccaaggtggttcttctctctcagtgcgttggtcatttcagagtgggaaaagccttcagctcagtgtccttcaggatccagtctactctttaaatttttgagagttatttggatttcagaaggatttgcctctcatcttctagtcatatcccattaccagtcaattcagaacatctattagttcagcaggagaggaaaggatgaatttccatgcctcccacctttgcttggtaacaggttatgcttttagaaatcacttcatgacctactgcttcctgctgggacaataatgttcttgtgtgtggctaagctatgcccacatttttaaaagttggaacacatctagtaaatatacatacctttgaaagtcctcatttaagctgaattagaccagtgaatagagtaataatgaaagtatttgaaggagggcaaccccttttctttaaaaggaaagagaataactaatatcaggaaaccaatcataccagtgaatcagagcccagttttggggactgaaagactcagggtgaaattgctgtgactccttgggctagtctctgtagttctcagaaactcagtaatgtcatctgtaaaatggaataataatgcccaattcatgtgtttgtagtgaagattgaaggagatactacctgcaaagtattcagatgtttgcctggtctatggtaattgccgaataaatgttacctgttatcccagtgttgtgtgcattgatggcaatgataaacaacaatacttgaggaattttgaggtttgattcatcattcttttaccttctgaaatttggcatccttggaaaatggaaaaagaaacaaaatttgtatattccttttgttgcagaaatgggtaattatgtgatatacacatacatatgtgtgtacattttataccaaaaattatatagaaaatgtacacacatataaatacacatacaattatatgtggtatgtatgaatgtattatgtgtaagatatatattataaatatataatatagagtatgtctggcagtatattctgttttgtgttatacataatataacaaaatgtatgttattagattacatagatttctggtatctatgttacaatcttttctaattaaaaattttttaaaaagtatctaaagaaaaagcatcagctgccccctgcaagttctctgaggactggcttttattattatttgttttgacacttcagtggcagcaacttccagttacagccagagtctcagtatgtaatcccgtggaaacgtccctaggtaacaggatgtgcccactggtcatggaagtcagttctgttaaacagggaggattttatctgtctgaataaatatttctgcagctcttctcacgctatggatttgagatgtgaacaggcaagaagggtcatcactataaatcaatagtttccatgaagttgccaccgatttagagcagacagcagcttttgggttgaaataaagatcgtgaagtgcagacgtaggcagcaaatgctggggataatgtgtggagtgtataggactattcagtgaacgtctatcaaggatggatagaaaggagaatgctctttttgagataagttagctaatcgataattggcaagggaaacatggaaatacttggtggaaattgatgccacctacaccaatccacacaagtacatgcacctcaaacctaccacccaatatccaattgtcaccaagtctatctaatcacatcttactcacctttgtgctactcacaagttgccatggaggtgagagtagacgcggtggggatggacgatctctctcaggacaggatgatagaaaaggaagaaaagaagatttgttttaaggatgggccacttctatgaatggttggaagaatggaggagagaaggacagcaaaaggtgataggagaggtggcaggtgaaccagggagggacagtttcctaaagggtagaaggaatttcatggagacagcaacccgtggatggtgccaaatctcatcatgaattgacaagagtccttggacttaccttcctgggagtcggttttatagattttgcacaactttgtacctaaatcattcccaacaattaagtgtgagttcccagagggcaggtaccagggtttattcattttggaaaccccagggtctggcagacatattagggatgaataaatgtgttttgaaagtatgaatgaatgaatgaatggataaataagtgctggccttaacataacagtttaatgtctgtgcaaaatgaaaataacaaagtgttaaagaagtaattagaaattggcaaaatggggcacaagaaaccatcttacatatgtggtagctctaggggtttaagaaataacatccctttatttccctactgagtaagaaccaatggagaaagaagctgggcaggaaggcaaaaggaaataaacaatcttctttcatttagcctaatgtttttaaggttctgctcccatccccgtgaagtgttgggaataggcaagtctatagagatgcgaagtagattagtaattgcctagggatggagcgtggactgcaaatgtgcacgaggcttccctcccggggtaataaaaaaaaagttctaaaattaaattgtggtgataatggcaccactgtgtgaatatactgaaagctactgaatcgtgtaccctgaattagtgaattttatggtttatgaactctatctcaataaaactggttttctaaacaagaaaacaaaaaggtttccgcttattaaataaacccaaatttaaaggtatggccgaatgggcttgcttgtactctcctgatttgtgcagacttgtccatcagtcactgaaagtgtggaaatcttcagtccatcctctggcctccagtagacacagacacacacacacacacacacacacacacacacagacacacacacaaaggtacacagacacacacacagacacacacagataaacacacagacacacagacacacacagactctccctctcactctcgctctgtcgctctctctctcactcatgagtgctgtagctgagaaagaagcccagagtatgctttttctgccagctggagaatttgacctagggctaagtgactagcctgagtacatccaggttcttttcccaaaggaaccaatttgataaaccattccttcttagcatggaggaatgagaagctggggagaggcccagaatattatgctagaaaaattcttgcacatggaaacacagggaaggaggataagggggtgcctccattcttatgtctcatactttttatgtccagtagtgtctgcatttctatcataaatactcttttaaaatcaggagtcctagaccagagaatgttccctgcattccatatcaggtaagatccaagtatacaaagcctgtctctttaattaatttcctttcacccaaatcctatccattgggcatgatcaatagttataaaacccatcatttccagtgttatggtaatgcgaaagcttgatgaaatatgggtttgaccacacagtagtcagaagtctagttcttcatgtattaaaggataccattccagctgggcacggtggctcacacctgtaatcccagcactttgggaggcggagacaggcggatcacgaggtcaggagatcgagaccatcctggctaacacagtgaaaccccgtctctactaaaaaatacaaaaaattagccgggcgtggtggcgggcgcctgtagtcccagctactcaggaggctgaggcaggagaatggcgtgaatccgggaggcagagcttgccgtgagccaagatcatgccactgcactccagcctgggcgacagagctagactctgtctgaaaaaaaaacaaaacaaaacaaacaaacaaaaaagatatcattccatctattgtgtgtttatctctgtttagttacgcacttgtgtgtagttgcattgacatttaggcagacttgcctattctagacattttcttactatgaaatgcacgtgactagcacagtgtctggttattagtcaattctcattaaatattggctgcataagggatggggatcataggcattcggaatataggaggatcgactctattctggcattattggatgaaaggggttctttattggaaccgactacatttttttgtccttggtaatattagtcttactttgaggcactagggcattttgagactagtgaaactcccatggccttcagaattataatttaaatcttctattcctccagaactcaggacatttaatttatcatgattcataaaagaccagtaataaaccctgtctttatttaaacgtgggcggcattgacttcccgctgtaggaattgggtgttctttatcaacgtctctctatctacttatcacggatcctgcatgtgtacaaaaaggcatctttgtcagtcagggggagattttattaactaaaggttcatttgttcttcaagtgacactatctctttggaattaccagatgttgttcaaactgtgccggctctccttttattctgatgatggcaaatgttgaatgtggtgaataaatattgggcactgtcctcggtcatctcaaataaatgtgataaaatgaaaacatgtcgcctctgaggtctcatttgttcccaggaagtccacggcgcattaaggcccacagacaatgaaagacgaatcagccattcactgggtattccattatgagacattcttgtcattttccagattgaattttagattaatatatagcctgagataagatggcatgtattgagatgatgccacagtgccatggccaaattgttttgttataatcacatgatatagagaattaaatgtattgtgatgatctgccgtagaaatttgcatttaaaagaaaaagtggcagaaaataaattaatagtaaatttcttatgacttagacctgaagaggctcatgtgactgcaggtgttatgttttgacccttctttgctaccatggcaagactggtgactgtcttctgaggagaagtagaggagatttcacttaactggatgatcacagagttgaggtttttgtcatccattgctgagccatgtattaaatattcattatatatataaatatacacacatacgtatatatacatacatatatatacatatatatacatatatatacatatatacacatatatatacatatatatacatatatacatacatatatacatatatacatacatatacatatatacatacatatatacatatatacatacatatacatatatacatatatacacacatatatatacacatatatatatatacatatatataataaaaaagtgggaaagaacaatctggcaaaacagacattttggaatcaccatgcccttctttttcgggtgatgcatgacacccatgaattaagatttaaaagaggatataaagcagaatcttgctttcacagtggggagaagaacttatgaatgctttgaaaataattgctaagaattatactcaaatcgtattacatcaagaaatggagatgtgaaccagactgggacagtacgatttcacaataacagccacaatttctctaatttattacattgtcatctgtcttgtgatttaacatcctttttcacagtctgcagtaatatatggaattactaaaagttggcggctgtctgacgttcagaaatgttgaaagaaatgaagtatttctgtgggtgttgccgaagtcctgttgaaagggtagttaagtatcgctgattaattcccattctatctctgatgaaatggagaaggggaaaatgctcctttcgaccaagtatctcattgcaaactgcagcccagaagttgcataagcattttccttcttcggtataaattgatttgctgtgaaaaatttcagacggttccatgtcaaggcaatgttttatttcgtggtgcaggacaaatgtagagctaagtagatttgtaggctaatttattggtcattttaatattgtgtattctcccctttggtgtgttaagtacttccccaatgcttcttcagcgatatactgcttatggcatgcccaactcatcttaattaaattctttcttgccacaacctcatttttgctcatgggatacattgctgtcactgtgaaacattttctaggaaaattgagatctatttttcataaattaggctcttttttaaggctctctatgttagtcacttaaattaatattaagttattatgtactccaaatcagtgctttataagtctttcaaaaaatatcggttgcccagaagcctgggaggagtgcgatagagctggagcgtaacgtgcaggtgtgttgggttagtgatgggtgaaatgactctatgtggctcgtccccacctcccattgttagaggcaatcagagaaagcattttgcaaatcgagaataagaaagaggccttacagagcatgttgccgctgctgctgctgctcctggcacccctgctgagatcagctcagtgcagtcttctcttttagaaagaggagaagagtttatcctgaactgtgcattttttagttttagaaaacatggatttcctgacaggaaatgggaagctttttgaactgtatgacttgagtcatctgtcacgttggaaggacattggaaaaatcagcctcctgatgtagaactttgtcatgactttcaaaagtttccctacaaattgacacatggggcttttggcttttgtcctggggatatggcagttgtcatgtcaatgtctagaaaaattgtcccttataaccaaagatggctaattaaacaaaacaaaacgcccaaacaggtgcttattcattccctccgtccgtcccactctcacacaggtaaagaacgtgtttcagctaagatgattaacatgcttcccccacccccaccccctgacttaaatcctcaagcccactagctcttgccttaccgccatgctgacttttacttccccaaacatacccagctcctcctgagtgggacgttgtgagcattctgctccctctgtctggaatgtgcccctcctgcctcaccacaacctttgcagagttagcttttacttctcctttcactctctactcaaaaatgccgcttcctccaggaaagtctttcctggaattcccacccctaatgcaactccaactccctaggatagatgagaatatgtctgtatttggtctcatagttccttgtacttttcctccagtttatatatacatatgtgtgtgtgtgtgtgtgtgtgtatatacatatgtgtatatatatgactgtttgtgtgtacatatatatatacacaaacacacactcacatagtcacatgtcatgtcaatgtctagataagttgtgccttataaccaaaagtgtctaattagacaaaacacccaaacaggggtttattcattctctcagtctatttctctcacatatatttagaacatgtatatgtatgtgtgtatatgtgtgtatatatacacacacacgtatgtatacatatatagatatagatccacacacagctgctagtaccactgctgagatcatctcagcaccatcttctcttttagaaagaggagaagagtttatcctgaactatgcattttttgagaaaacatgaatttcatgttgaggaaatgggaagctttttgaactgtatgacttgagtcacctgtcgtgttggaaggacattggaaaataggacgtgtgggtgtatgtgtatatatatacatacatacatgtatacacacacacatatatgtgaatatatacccacacacacaaataagtacataggtatatatctgtgtatatatatccctctataatctgtgtgtgtctatatatctatatctctttatatccatatattgaacacctactatgtgccaggcgctcttcctgcatttggaacttgttggtgtaaagacgacaaactgaagttgttccctgaagctcccttatctgcctaaagtctggacccactaaaaaagaaaacaagaacctctggttccttccctgagttctcattaattgaactcatattgcaggaagaaagactgatgttttccaacccacatgaacagacttttgtcacaggccattgttcttcaagcccattgagttcccgtaaaaatcacttactacctatgctaaaatcatccacactttcccatttccctttcccctaagaagaaggatatataaccatctgtatcacattgtgcggtggggtaatcactctgttattctgccccatgcatggtaatcaattcgtttgccatttatcaaaaaaaaaaaaaaaaaaaagtcaagccctcatgaagtcaatattctagttggggggaaaaacaatgaaaagtgtgcgtgatgcctgagcaaattgtgttagaacatgagcagtgctatggaaaaaagaaaaccaaaacagaaaaggatgaggagggcaggagagtgggggtggaagaatccattgcaattttacatgaggaggagagggccagtgtgggccttactgtgaaggtgacattttggcataaagccagctgcatggatttggaagagcattccaggcagtgaaaacagtcaaagcaaaagatctaaggcttgagagtagccgtctgttcaagagacaatagaagggccagagggagtggagcggaaaatagcagggaatgagttgagggaagaagcaaggtgaggaggaggtgcaaaccacttaggacttgtaggcattcagggcctttggattttacttgagtaaaatagggtcttgacttacatttcaaatgaataatttgaacttctgcattgaaaattgattatgagggcgcttaatgcagtttatagctgtgtacttgtgtgattatgtggttgatgtctgtctctctcatagactgtaggccctaagagggctggagtactgtctgacttgctcttcatggaatctccaagatcaagcctagtgcttggcatgttgctgtccaataaatatttaatgtgaaaggataaaatgaatgcaggccacatcaagatgatgctagttggcattcatccctcagaggcatgtgctgtagatagtcaatgtgcaaatttcaacttgtatccatccacttaaagacaacttcaaacgcaccctccaaccacaggcttaagttgaattatctgcttaattgttgctatgtgcagctgtttttcattagtgctgttttaatttgcagtctatgaactttgatatttgtaacaaaaagtaattggatactagtctggaaggcttccctccttaaaatgaatatgcttcacgcccaagcaaatgactggaaaggttccctgctgtctactagggaaaagattcacgggggcaggggctgtccacagcagaccagaatgttacagtctgctgggtaaatgttccatggtttcagaattaatatgcatgcattccgtaatacatatttacctggtagtctgtaaccattcagtagaactgttacagtctagtaagtaaataacatgtttttcaaaattagaacgtgtaccaaatatgtatttacccaataggctgtaacagttctgaggaaaccttccctgttgttagtctatcaggctgacttatggatatgggtttaatgttgttttgaatatgaacacagtataaaggaagatgtgtgatttttagaagggcgaggggttgtcatgtagaacaaaccaattttaggaggaaaattcaattcagttgcagaatctgttcctgctattcttttcctttcttttattttatctttttgttttttcttttatgctagttgctggaagattgctaatgacaccaggatgaatttttaaatactgtaatttaattattggtaacataatatggctttataagtgattagtggacagatttctgaacatgtgtaggggccagttttttagttgctaacctcatggccttggaggaatccacaagttggattctggtgaatgatttaatgacggtattggcagcactttgcctaatgagtatgtatcactctggcctaggtaagtcaagctaaagctaaccacattcacatcatccacctagatctgttatacaggaacaaactgtgtagagatcattatgaggccatgttggtgctttaaggcatggagttttcagcgggatattactcatttccatcattactgatgttcagctgcatttctactgatgtcggctgcatgggtagagaattagactccatagttcaagatagttcatgggtaagtaacattgtagtcaagagtttgtggctctggaatcagatgacttgggtgccagccctctgaacttgtatcagtgatttaaccactttaagacctgattaccttatctgtacaattagagattgccttatctgcacactaattgtacagaacagtcattgtacagataaggcaacactagtattcactttataacattcttgtgagtgaaatagtatccataaactgtgtatcactcttcagagcacatattgaatatttaataggcatcatcaacttttgtctatgatcactgtggaaattcagctgtgctggcatacaggaggtatatgtagcaggattagcaagggtgactcagtccaggtttccaagtatttagtttggaagtaaatgaagacacgatgtgtgtaattggatatttcactaataggttataagtggttgtgcaagtttctaaacatcttgcatgtactaataaatacttttagttgacaaatgagaaagcagccatgaatctgagtctcttacttggaaccaggtgaaacagtgatttatgaaatgccctttaaaactccttggaggttcacattctgcacaagttgctttttttctttctaattgagaaagctgctatattttgagtctgtgtaagcaactgcaggccttgattcttgattcttttctttctttctttctttctttctttctttctttctttctttctttcttttttttttttttttttgcatagttgttactgtttccttgggcagagagccataggatgagtcccacagccctttcctgggtatgtccttctgtgcaatgtaccttccatgaagcttaccagcatgttttatcatgtgttcaatgtcatttgcacaattagactcagatgctgcaggggcagggggccatggagtatactcacttcttccaagtgctgtttccccaggcccaagtgcaatgcctggtgcaaaatgaatactcaggtggttcctgtgttgtcgtcctttgtgactctgtctctctgaattagttctagtccatggcactgcgtgacttccaagacaattttagcatcctgtgcaacacgcatgagatttagaagcattgtctgttgacattattctttatgaacatttactgagagcttacaatgggccaggcactattctaagcatttcacatcaatatttcataggaatccatttaagtccatcttattattaccctcatttatcagatgagaaactgggatcccccctagattggatgtgtataagttattgagatgtaagtcaaaaaatttggtgcatccctagagcccagagtcccttacatctactctaccttgtctcccaaggaaaatactatggtcaggagttgggtaagccgataaaaagatggctgggtgtggtggctcacgcctgtacttccagcactttgcgaggccaaggtaggcagattgtttgagctcaggggttcacgaccgttatcagcaacgtggcaaaagctcatctctacaaaaatacaaaaaaagtagccaagcatggtggcacacactggtagtagggcacacacatcagtagggcttgggaggtggaggttgcagtgagctgagactgagccactgcaatccagtctaggagacacagtgggatcctgtctccaaaaaaaaaatatatatatatgtgtgtgtgtgtgtgtatgtatgtatatgtatgtgtgtgtgtgtatatgtgcgtatatgtgtgtgtgtgtatatatatatatcccattaggtctgcctgccacagtggggatcattcttcaacatgagatttggaggggacagacatgtaaactacagcacccatgttgtttctgcttcttcccagcaagctatttctagccacccttcacctccaccaaccttaacctcacaatcacttctggatgttcttgtagcctacactgtggattgttctaggctctttaattttctgttttccacgaaagtctgtaagcttgatgaggataaaagccatgattgccttgcttaccctcactgtgaatgaatgaatggagtggtgcagaaactcaagagcatcatgtacatatggaacatgctctatggtttttaatgaaaatatgtggcagtattggctgggctgcagtgcatacagtggagtattattcagctataaaaagaaggaaatactgtgttcgtaaaaacatggtgtgaacccaggagacagagcttgcagtgagccgagatcgtgccactacactccagcctgggcaacagagtgagactctgtctcaaaaacaaacaaaaacaaacaaaaataaacaaacaaacacatgggtaaacctgggggacaccgtgctaagtgagataagccaggcacagaatgacaaataccgcatgatctcactgatatatggaatctaaaaagctgaactcttggaagcagagagtagaaaggtggttggcaaggtttgggggtgggggaaatggagagctgttggtcaaaacacacaaatttcagtaaaaagatgaacaggttctgaggatcttgttccccagtgtgggtggtgatggatgtgttaatttatttgattgcggtaatcattacacaaggcatatataaatcatcacattgtacaccttgaatctgttcagtccttatttaaaaattttttaaaattaaagcatttgcggctgggcacggtggctcatgtctgtaatcccagcactttgagaggctaaggtgggaggatcacttgaggtcaggagttggagatcagcttggccaacatggtgaaaccccatttgtactaaaaatacaaaaattagctggatgtgctggcatgcacttgtaatcctggggagactaaacaagaattgcttgaacccaggagacagaggttgtagtgagcagagattgcatcactgcactccagcctgggtggggagactctgtctccaaaaaaaaaaaaaaaaaagcatttgcaacagggaaggtaaactacagtgataacaaaatactactcattgtagaaaagacaaagtacaaatagccataggcccccaaatgtgaaatgactttttcttttcttttctttttttttgtctgagacagagtctcactctgttgcccaggctggagctcagtggcgcgatcttggctcactgcaacctccatctcccagattcaagctgattctcctgcctcagcctcccaagtagctggaactacaggcgcccgccaccatgcctggctaattttttgtatttttagtagagatggggtttcaccatgttagccaggatggtctcgatctcctgacctcgtgatccacctgcttcggcttcccaaagtgctcggattacaggtgtgagtcactgcgcccagctcccagattcaagccgattctcctgcctcagcctcccaagtagctggaactacaggagcctgctaccacgcctggctatttttttgtatttttagtagagacgggggtttcaccatgttagccaggatggtctcgatctcctgacctcgtgatccgcccgctttggctttccaaagtgctgggattacaggtgtgagtcactgcacccagctcactttttctttaatttttgctataagctcacctgatgaaaaaaagagctggaaggattagcagctatgtgaggctatcaatcagggtaagacaggctatgctgtagtaacacataacccccaatatccatggcttaaaagaaccaatgtgctttgtttttgtttttgtttttttcctcacatatttctctctgttcatcctgcactggctgggagtgctactctatttgttcttcatgcagggtcacaggttacacctcttctgcgattaccaggacagagaacaaacagagttaattgcacactgttccttcaaggtgttatcccaaagtaatgtgtgtcatcactgttcaaatttattagctaaaacaagacattcagctatgcctaagtccaagtaggcaaggaggtacaatcacctccgttgttttgaaggagaaacataattttttggtgaaaagcaactgagatccaccacggtgagaaaaagccacaggccagtctcacagcatcatggcgaacagctatgcctaattgcacctcgattctaggtgtgatcctgtcaaaagcagtacctttaagatgtgtagttatagtattgtcattctaaaatatgtaacttttaggaattttgtggctagacgtagggacctccatttgattttttttttcttctcttcttagtgagcctagtttgaaatgttggctttcttaatctacagagactttgtcattaatgtgtaatgaatatctggtttcaaaccataggctgcttatcccttgactatttgtcgagacctttgtttgccgaaatactgctttatttcatttcttattatctttagaaggtattactgataggtattcattttgacccctttacgcacactcctcaagtctgtcttctccacaggctaaatcagtattccatccacttttcatctttactgttcctggcactctcatctatatgagaaacaggatctgtgtttgacaagcatgcttaccctttgcttactgttttaataaaaatttctatcagcgtttttatctgcagtagcagtcgagacactgtttgatattgagatgctagatttcatggactttgaaatattttccccatatcttttttggcaagtctttgaacatagaccacaaaaaattgacatgttggagatgaatttacagactctaagttaactaatgactacctgtcccagcttaaattgtgttctaggattgaaacattatattacacagtcaaatcgttgaaattaatggtcagactcttccataactgagttagtttcccatgagactgatactctattaaatgagcaggctgtccagatttctctgcatcgcctttggtttggggataatgttgacccagtcttggcagtttcaaagcagtaccaagcagtcagactattttaaatggggaatgatgaatagcagcttcctaatctccaaatttcattcagatacggtatcttatttcatcccctttatcctgtgaggcaaattattattgtcctgaacacagagagatggggaaactgaggcatggatgttactctgtgtgctgaagattatacaactactgagtagctcaggttcgtttggtctttctgtccctagatagcctcttggctggcagttctcatgattcaggactcttctcaaatatctctcatgagagaggcctttcttggctgctccagccacagagacagtcaccctggttctctgctctgtcaccttcatagcacttattactatttcattgtgtttcttatgtgtctgcttgttctcagtctctgtccacttgagaacaaaggaaaggaccttgtctctttcatttcagcgccacatcccagcactacaccagtgcctggcacccagtagatattctgaaatgtcagtggatggatgcctatttacatactgtgcttttcttgtccctcagggccacatttttgagttggtccatacaaagcaacaaattaagcatttagggctttatggacaaaccccactatttttttaaaattttttaaaattcctttttagagacagggtctcactctgtcacccaggctggagtgagtggtgagattacagtttgctggagccttgaactgccaggctcaagcaatcttcccacctcagcctcccgagtagctgggactacaggcgcatgccaccatgccaggctaattatttaaattctttgtagaggtagggtctgactatgttgaacaggctggccttgaacttctggcctgaagtggtccactatttaaggtctttgacagtgcagctttacgggtaatgacatgtattagttatctaataccatgtaacaaattactcccaaagttagcctctcaaaacaacaaaagtttctttttcatctcatagagtttctgaggtccaggaatctgggagtggctctagctctagtttccttgtgaggtggtggttcagtacatcagctggggcagccgtcagtgacagttggaagtactgcttctagactcactcatatggatattggcaggcctcagttcttcaccacatgggcctctttacaggctgctggagtgtcctggagacatggcggatggctctctaccaaattgagttatgagacagagaaagcggggagagaaaagggagaaagaagggagagatgctaagatggaagccatagtcttttataacccaacctcagagtgacataccatcacttctgccatgttccattggaactcttgtacagtgtgggaggagatggcacaaaggcacgaataacagaagatggggattatctcagggccatcttgggggttcattctcatgtatcttattctgattctcagaagagagccctggatagaacatgtaactctgtataacagtaaatcatttcctaatgtcttcttccatttcaggggccagttgggtggaaagtttgattaccagtgtgcttataactcttttttttattattttttgagattgagtcttctctgacacccaggctggagtgcagtggcgcgatctcggctcactgcaacctccgcctcctgggtttaagcgattatcctgcctcagcactgcccccaagtagctgggagtacaggcacgtgccattatgcccacgtgatttttccatttttagtacagatgggatttcaccacattggccaggctggtctcaaactcccaaccttaaatgatctgcctacctcagcctcccacaatactgggattagagatagctcttggataatatgctacttaagaatacagattctggtgtcagcagcccagctttgaatactctctctgcctcttgatatccatgtaaactgaggatattttgaagcttttcttcttacagaattgtggaagcaatgtataagttatctaatactctgtattagttatctaatactgtgtaagaaattactcccaaagttagcctctcaaaacaacaaacatttctttttgttgaatgagttttcatctcattgctgtagaataggatcctagtagtatctacctcatggagttgtgaggattcagtaagttacttcatgtgatgctcataccagaatgtttgccagactaagggcacttaggaagtgttgacttttattctttggattatcccacagctaatcagtgccaaagtaattgttgcttcccatagcttatccttcactagatggaagtgtcctagacagacctctgagacgaagtcagtctaaacaacttctggcaagctatgagctgtaattgggttaaatagttgcgacgtggagaaatctacttttctgttgcagaagtttcatgggctctgtcaacctttctgtccatgggtggttttctgtgggaacccatcctgtgagtaccttgacaataacagcttacctaccatccagaatttagtattctcccttcattctctagagaaaacccaagcataccttcctgagtggttggccagtggctgaattccacggctgtttcgttaagttctctttaagcagatttttcaagtcttccctatttatatcttttgaaatccaatctccttcaatcaattttaatcccctaatgtgtttgctataagtactgtacaattcacttgtcctcaataataaaattcattttggtgcagcctgccggtaatttgtttgagaagaagtcgttaggaaacccttgcattctcttctggtttagaggacgaccttcagtattgatagcattttgttgtcatgcgcttgaagtattctttcatgattgacagtgccgtttaaataatggactacagagccatgtgcttaaatgaaatctgactacactaatttcgttatatattaggaaacttcaagtgttctacaaggacacgatttcattgaccatggatttatattttcagtttgtatgaattatacccattgtgtattgttcccccttcactgtaagatactcttttgttttgaaaatcagtgtttttgtgttttaactctcaatgtatgctgcataagcaaaggattgtgttccaggcccctcctggaacaggccaaagtaagtaaaatcgagaattttttatatgaaagatagaagaagtacagcattattgactcagcttaatactgagttaatacactctaataaggctcagaagatataaaagatccactgtactctctctatatatatatatacacacatacatacacatataaaatataatttatacatgtatgcttaattggaaaaaataaagatcaagagcatgttttattgtttatctgtatctctagctttttttaacagcatataaagacaaagcacctttttatttaggcttggctaaaaattatcagtcatatgtagatgattttgcagtatccgccaacttcctactcaggaaaagttatagcagatggcagaatttatgtgccatgtggcatttgtttaagtgtggaaatagctaatattttttcctcaattattataactattttacttttaaagactcaattaactttgaaataccattcttgatgggtgcctcagttaaggatgggatggggagaaggaagagaaatttgaaatcttgcagggcctttgattgaataacggttatattgctcattaatcagaggctctgggtaccctgttttcaaaataacattattgtttactaaatatagactcctgtggaactgttaaggagaaggtcctactgagatgagcaggcattgtggattggcctttctactaccaaggactgggattcacatttgcaagtttgtgggtcctcagggagaatatcttggagttgacatcatttcaggcatatagcccgtaatttgttttgacaactacaaacaaaaggggtctattcccaaaaggcttcttcgaaaattgtcagaggctcttgccgttgataatgtgagctgctgctcccagggctgagggcctgagaaccacagcaggactggaatccagtgggaggagcaaggaagctgcagggggtgacggtgggcatccttccagagagaagggcacatttgaaacctaggagaccattcctgtcaggaatcaatatcaggtgactgtgatctatggcagagacccagtgctcggagtgatttttttaagttgtgtatgcttcatatagattttctttcctgatttgagtttttctacttgggtgaaataaaaggcaaggggtttgtgtgctggggtagtcggggagagaggagaggatttgatggagaacatcaaggacctgttgcttgcctgttttctaggaatccttacctgtaatcagctcattacagagaatcttggggttctcttgagcctgctgaaggcatgcctcctgagatccattgaatagagcaaaaggatcagtcaggaaatatttattacacagaggaaagaagaatgcaccagcagagttctgggcctgctgcagccactcagtaaatattttttgagtgaattaatttatcaaaaaagcatatgtaaaaatatgagtcattatcatgagtggtttgattgaggatgatatttcttttcttagtttttacaactgttggtaacatttgattaattacttttattacaattatgattatcatcattttatatacagttgtactccttgcctgtgttaacaatttggtgatagcctttcacatttttatacctttacatggcctgtataagtatacagttttgtcctaatatacatgaaataataaaaagtggatttttctgccaatacacacttagcaagcgttccagggtctctttatgtattagaacataatctcattgtcatctcattctttttaaaacgttacttgatatcccgtcgtggaagtataatatttatttaaatatgttttgcctatatttgatttcataatgtatatttttaagtgacaaatctgtatcaaattctataggacatagagaataaacccatgactcttccaagttgtctgagatctagttatgaattttgcacattttcttaatgagtatgttctgcttttaaaacattaaaggttgaagaacgttttaaatctacttacaggatcaaaactatgcacatgaaaagaatgtctaacctttgttgggctcttatctaagagacactaagcgtgcatgtacaaatatatataaactcattaaaatcccttccattatttagcgtgaaccgtagcatagccaggcaagattgctgagtcttccccagatggac[133 bp omitted]ctcttgcctcagcctcccgagtagctagaattacaggtgtgagatatgcacccagctaattttttgtgtcttttagtagaaacggggtttcaccatgttggccacgctggcctcgaactcctgacctcaagtgatccacccaccttcgcctcccaaagtgttgggatttcaggagtgatcccgcatgcccagccatcaataaatacttactaagtgcctactttgttcccaagagtgctgggaacttagcagtgaacaaaataaataccttccctcggggaccttgaactcaagtctagtcagggatcactctattaagagatcaagtcaacactcaattctcctacagactcagataggatagtattttaatttctcgttgatctgctccctcagaccctagaccatgggcactgcagatttttgcaccttttgtagaggcagggtttcaccactaccagagactttaccatcatttctatgtgaagggaaacagtgccctttcagtagacaacgttaaatcagccatcagacgtgggtcatggtgggtttgccgtgactgccacaaacacgcctcaccgaagtctgccaggggacgccataccctcccctagaaagtaagaaacagagaaaggctttctcctgccccggactgtctttctctcagctctaagaaatttctttacagctgttactttatcctggcctgtctcttgagtaagaaaactgctggaaagagtctgccattcactcagatcataatcagggagcctgctgtcactcaggaagggctttaaaaaattcttctgatttactgtgagtgcaaatctctgatattcctgcatctccccatccatcttattttgattttacacatagtgcgattttgaaaggaagcggtgtttttggagaggtagaaaaactctggaaaataaggcttatgacgttggccatcagcacggggctgctgtctgctgtgtgacatgctcaggggtgacgcgcctcccgaaagagacacttggtagagaaggcacgggcgcgaagcccggctgcgggagagctgggagcctgaatgtcgctggctgccgttcacagcaggctctctctgagcaccgtggggaggcagtgacacccgctggcctcgcagcgacactccggcagctgtcctgttttccagcctggacgtgataggtgtgtcttggaggacagtcagaggaagacaggcaagccatactggcctccctcgaggttataccctcgcttaggttaggttgcttctaacagacatcctccgcgggcgttgaggcagccagcttcactgtcacccagacaatttttctctcgctctgccaaccctgttcccctttcaagaatgtttaaactcttcattcaagcgatgagagggaaacacttgagctgcacactcaaggagatgtgggtttccattctggccttgcgatatattattggtgggaccgtgggtgagtcacttaacttctctagtcctcagttttcttatctgtaaagtgggctccagcatacggcttaactgaggtaacacacgttgttcatgtcagctgttgctttcatgccggctctgcctaggtctccccatggcaacaggataggagttctctgcctgtgcgtcagtttttcactagcgtgggaatgctgtgaggagggggcggaactcggtgtagcaagggtttctgtccgtatcttctattttttttttttttttttttttgagactgagtcttgctctgtcgctcaggctggagtgcagtggcgcgatctccgctcactgcaagctccgcttccagggttcacgccattctcctgcctcagcctcccaagtagctgggactacaggcgcccgccaccaagcccagctaattttttgtatttttagtagagacggggtttcaccgttttagccgggatggtctcgatctcctgacctcgtgatccgcccgcctcggcctcccaaagtgctgggattacaggcgtgactaccgcgcccggcccgtatcttctattaagaaccagcaaccacgggctgggcgtggtggctcacgcctgtaatcccagcacttagggaggccaaagtgggcggatcacgaggtcaggcgatccagaccatcctggataacacggtgaaaccccgtctctactaaaaatacaaaaaatttggcaggcgtggtggcgggcgcctgtagtcccagctactcgggaggctgagggaggagaatggcgtgaacctgggaggcggagcttgcagtgagccgagatggcaccactgcactccagcttgggggacagagcgagactccgtctcaattaaaaaaaaaaaaaaaaaaaaacagcatccaggaatgctatcgtgtagttgctttgagacatggcctggggtctccccgcaaggcgacaggacagattacgacacgttgtttgaaatctgcctttagaaaaagacacggcctcattttatgcctgtgagtgatttttcttctgtgtcatatcataactctgataaagataattacatcctagtgtctaaaggcaatgatgtgcttgattaagcctatgcatgttgtttggtccttgtatatttatattttcttcaaatttaaatggatactaagtcctctcaacattgtctatagattgctggaaactgtgactttaagcaaaatgacgtgtaacagaataccttttaccatgagctgattgatacaaacaagagttaagttcctgcagcacatttctggtcataaaagcatcactgatcttctaaataaagacccaaaacacttctaaaattaaacatgaaaacacatgtgaaccatacatacattttaaaaagattaataaagggctaggcacggtggctcatgcctgtaatcccagcactttgggaggccacggtgggcagatcacctgaggtcaggaatttgagaccagactgatcaatgtggtgaaacactgtctgtactaaaagtacagaaattaactggtgtggtagcagacgcctgtaatcccaggtactcgggaggctgaggcaggagaatcgcttgaacccaggaggtggaggttgtagttagccaagatcacagcactgcactctagtctgggtgacagagtgagactccatctcaataaaaaataaataaataaataaataaataaataaataaagattaataaaaacatgcaagataatttagccagtttttgattaatcagtgatggtggtggtaggcatggtgcgttacatcaaaaaataattttttatttttgcaaagcaaaaactgtcaggagcacctccccccatcacacagttcaaaaacaatgactagcatggcaggctcactgggcaccttcataccgcattgtttattgttgtgcacttttatgattagcatctactttatcagtttttatttggcagtcgtgagtattcattctttcattttgcaacctgcttattccagttcaggctttcgagtgggtggagcctgtcgtagcatctcagggcacaaggcagggaccactctggtcaggatgtgctgacacacacactcactcatgctgagacgacgtagacatgccatttccccaaacacgcacatctttgggatgtgggaggaaaccggagtacccggagaaaacctacgcagacatggggagaagatgccaactccacatagtggacccagttgggaatcagatttttttcttatcaacattgtaacataatattattcgaagacctgctgtactctgaactgttcattcttctaagggtcttaaaaacttgaggacattgaaatgctatggctcaccctcctattttctttcttaggtatgtttttactgagtcctctgaaccttctttgaactccaactgggaggaaataacagctaatggggggttgttcctatttttgttggcagggtgagggaggtggtgactgaggtcaaactatgtggaaggatattttatttactaaaacaaaagaggcaataattttttactgcaacgttagggatttatgctagataaaaggaagttcccacaatcctgggggaagggtgttaagccaaggcaaagatttcacagctgttgggaaattgctttctgaaaatactaaaggatacagtgccagagtcactggccatctgctaataatttatgttcctcatccccagcaaagataaagaacctgtaaagaaccacccatctagggatacatttccagccccccttttatcaaagcggtgacatgtgaccgaattctgcccagtgacatgtgggaagaagtggctctttcaggactgttcccccaaaactgtctttgggatgctccaaacttctttattcccccaatcctctgatgaacatgcacctgacattggatgctacatgttaaaaacggagttgtcatcttctacctgggtcgctgaatgactgtgtggatcaggaagctccccactcttccctgccatgactgaactagccactgtcatctggagggtgtctgtaatagcatctagcattgcctaacatcatactaatggaacactacatattttcatctgaagtgatatcagtggaatttccactgaaagcaaaggtttagattttggagcaataatgcttaatatttgtcagtaggagcttattaaatataaataccagtcccagtgcttagaactttttatgtgctgtctcctttcattttccttccaactctccagtttgtatcagtcggggaacaccaagttgtgctgtggtgacaaatagctctgaaatctcagtgatataacacaacaaaggtttatttcttgctgatgaagattcactgaggttctgggacactctacagagaagctcttctgcatgtattggctcatcattcccagtggttttactcttaggaacccaccatgtcaataagtagttccacatggtcccaggggaagtccacctggatgtctcacagtggtagtcaagtgctttgacaaggaagtgacacaccctactatcaccaaatcccattggccagaaccagtcacatggcctccttttccctcctgtatccctactatgtgctcaggaaaaaaataaaccagatagtgaagcaggaaggactatatggaaggatattttatttattaaacaaacgaggcaatcattttttactgcaatgtcatacaaatgagaaggctgggattcagagagcttcagtcactaggacaaggttacccagttaggaaagcacaggttttgtgatgaagggtgtcacccaacagtgcttatttcattgaagagccatttctaaaattacttttctgtgttacaacaaaaaataaggtaataagttagtcctcaagcatcttgcagttcagagctggaaacagacaagtaaaacgaccagttacctgcattctaactactactagacatcagatagcactttacatatcattacctcatatcttacgtagtgataagggaatgtgagaaaacttttgcaagtcatcacaaaacacttttttcaggggcataagaatcttggcctaaaatggatcatcatgtaacaggctgagaacagggtagtgggaagttagcgaagcaatgtccccgggacacagcagtgggtgaaagtgtgttgtgattcatgaccttatggatggacggtgttctcatccatctgtccttggctgggtagctgatggaacagtgatctgcttctctgggtatttgggagaaataaataaaaatccatggtaaaatgaagctgtgttctgcattttactcagcacaagcattctgtcctaaactccaaacattgtgcccaatggggatgtcggctatgggtattggtgtgtgtgcgtgtgtgtgtgtgtgagcatgggagaaacagagggacataggaagagacaaaaatatagagaaggagagagaaccccagagagagagaaacagagagtgaagaagaaacagaatattttccatttatttcaagtcagttatcccaagttttagtgggatcaaagtaaaatagataaaaatgtatttattaaatataatatagatttttttaagtatatttcctggttgctaaaaaataatctttgctcgaggcataagaatgatacaatggactttggggacttgggggaaagggtgggagtggggtgagggtaaaagactgcaaattgggtacagtgtacaaattacggctctggtgatgggtgtaccaaactgtcggaaatcaccactaaagcacttatttatgtaaccaaacaccacctgttttcccaaaacctatgaaaatataaaaataacaaataatttttgaaaatatttgctcaaaaatgaggctactgaaatgatgttatgttttcttctattttggttctacctagagaaattttaatgttttatgccaagctgttcatgcttagttctgtttttgttttgttttcttttttgttattgttgtttttgtttttgagaaaaggtcttattctgttacccaggctggagtgtagtggttcagttatcgctctctgtaggcttgatctactgggctcaagcagtcctcccacctcggtctcttgagtagctgggactatatgcatgcaccaccacacctggtgatatggtttggctttgtgtctccacccaaatctcatcttgaattgtagttcccataatccccatgtgtcatgggagggacctggtggaaggtaattgaatcatgggaatggttacttccatgctgttcttgggatagggagcgagttctcacaaaacctaatggttttgtaacgggcttttcctcctttgctctgcacttttccttgctgctgccatgtgaagaaaagcctgtttgcttccccttccgccacgattagaagtgttctgaggcttcccaagccatgctgaactgtgagtcagttatacctctttcctttataaacactaagtctcaggtatatctttagtagcagcgtgggaacagactaatacacttggctaatttttcaatttttttgtagagacacggtctcactatgttgcccagggtggtctcaaactcctggtctcaagctgtcctcccatatcagcctcctaaagtgctaggattataggtgtgagccactgccgccagccttcagtcctttttaaagtggtatacatattctatgtataggttcatggacctgttcatcttttttttgttgttttttcttttttcttttctgagacagagtcttgctctgtcgcccaggctggagtgcagcggtgtgatctcagatcactgcaacttctgcctcccgggttcaagtgattcttctgcctcagcctcccaggtagctgggattacaggtgcccaccaccgcacctagctaacttttgtgtttttagaagagacagggtttcaccatgtcagccaggctggtctcgaactcctgacctcataatctgccctcctcagcctcccaaagtgctgggattacaggcatgagccaccatgcccggccaggcctgttcatcttttaagggtttatgttgtttgactttttccatcacaaatttttattcacctcagtttgctgataactatttccaggtaagctggagtcataacacacatttgccaattatctggagaggagcactacttcctaattatgtggtcattgaagagctagttgatcattaagctacactgatatgcaaagccacaataataaacagcaggcaagattaaaaactccgtaagacataatcccttatggtcctcttcataaacatacaaataatgaaaaaataaatacacgtttgctcaattctgcaaaaccagaaatgtcacagggggggatgcataatagtgattgtattgagggaccaaccttggttgattcttttgtggggtatacacagtaaactcagacataaacctgcaaggtaggcatcattattctccttacctttctagagatgagaccagctgaggctcagagaagtaagttccctggccccacaaagctaatgaagccctggagtttagattcagacacagattctgttatccccaaagactaagaccctcaaaacatgtcaagtgttaaccgatgcctaaatggaactcaatttttccagaaagaccctgcatatctcatttgggcttgcttttttttttttttttgccctttttttcccccaaaatcataattgcaaaggcaagcttctgaagcattgatcaagaatatattttgctttggatgaagaatgtgaaaaatgtgattttagaagaatgctgtaaatatttctcccacttcattttcttttcccttctcctttttccatgctgtgccttttgagttatccccatatactctaagtgccaggtaggtccacgtgggacaaccagagtctaatgagttcctgcgccacgcccacccctaatgaagcatcttcaagtaggatttctaaagacccagggaagctttccctttggtgatttgcaaagtctggccactttagaatttatctcctgcacagggttctgtgtctttgctttttcgatgatccctgtgaagcatgaacccagcacccttgccttcctctttgttggagatggtggttatttgtttgagtcttttagggtgctttattttgttggtttcactgttggcagctggtacaggcttccttcccccagctgtgttggctgttgttttgggaaacaagccttgctcttttccatgcagacctctaccctgggctctgatggtctagctgaggtgaagcaaaccgtaggtgagtgccaacaggggatggccccttcctgggcagaaggcggatatcgatctcatgtcagtcatgttgcctgtctatgaaaatactacatgagcttctcagaaacaggtgatctattgatccccaagctgctaagggggcctccctcatgggttctgcttagctccttaatgagggactcacagctgtgtttatggaggtcacctggaactagaggcaggttttactgggaactctcaaactttgtgaaaattggatgtgtgtcccagattcttagctttggtgttatatccctcaaaggatgccactgagattacatgtccaacacaatcagaggcatttcaacatgtcaaggttttcttttgccctaggcattcatataaaccaatcgttatgaaaccggggcatttttgcttcccaaaggatattgataatctttggttgttgcagttgaagggatgctaccagcatctagtgggaaaagccaggggtgctgtactgctgcacatctaacaaggcaaagaccagctccccacccaacaaagaattattgggttcaaaatggcaatagcattgaggctgagaaagctgatttaagtcatattaaaatggaccccttgtaaatataaaacacaattttgtgatagtaaaaatttccaaagaatttttatcactttcctattgaagtgaattaactcttaatagctcattgaatttatgattagctattatttctcagtaatcatcgcataaacttgaaaattctgatgagaaaaataatgtacaacttattttccaacatgataaaatatttatgaacactaaatttaacaattaatgatgctgacataatgttgcattttggagaaatataattaagcagttattaattttgtctttgttccttgaaatgttagcgccaatttttttttttttcaatttttagatgcccttggacctcaaaggccctgacactgcatgtggagtcaggtgcataaaacatccttgaatctattaattctgggcctcctcaatgaaaggttaaattcatttaaaatacttaaatgatgacatcgtagatccaagaggtcaaataaaataaggatttagtctttttttctctcctttctttttccctccaccatttctctcttctcacttcttcatttctcatcttcttcctctcctgaccgctccttcctccctttctcttctttcctcccctttctttccttcctctttcccttccctcccctttcctagcttcccctcccctcctcacccctttttgaaatgttggagttcatttcaacagaaacaactgagctacagttccagctggttttctaagctacagttcaattattactattatttgcaatttttctcccctcccctcccctcctcttttctcctttccttgaatctattaattctggacctccctcttcctcactcttctctcctctcctctcttgtctcttgctcgatgtctctctctctctcacccttctctttggtgttcactccattctcaggtaaattctccccacaaggaagaggatggatagtatcagagccagcattctccactcagaaagccagctggaagatagagatctcatttcttggttgcttcagcaaaaggcccaggagtagttctaatgggtcctagcataaataaatcactgtggtccggggcacatggcactcattggccagcttggaacacatgtgcaacttcaggaccaggaactacctttccctgagacacttggtctgacagtgggaaatgggtgggttgcgtgcagagcaatgggcctgctgatgccaaacaagaggaatgataccagccaatcaacaaatgtctgctccttaaacaactgcaatgttaagttttgggggagcatctcacactagccctgtggatgaacagtgcttagtcaatggaggaaataactagaactttattagcttccattttacattttattcctttcttccaagtaattgggattggggagagcatcttgttacctgtcgcctttttaactggattctatccattctctgtaactcttagttctttgctctctggctggttttgtcaaggtaactaggtattttaaatcacagtgcaatttcttgtggctcagaaaactgaactgaagtagtaacttttaataggtcaattacattatttttcagcagcctgctgcagcctaatgaaactgcagtttaattaggttggtgtgacgccaaaataaatgtttcattcccagcttgttttatttactcattgaaaagtaggggaatctacaaataataggattggaaaatgttaaaggctaatcagtttggctgcacttgtttgtaaagaaagacgattgtatcttcatcactccagtttggtagttgagaaagctgaaaaacaaataaacaataacaacgacaacaacatttaaaaaaaaaaaagaaactcaaaattgtaggattccttagtagaaggttcttttaacaataataaagtcaactgcaaatactgaaagaccattcagaaagaaacgtaaccaagtcagagtctcctaatgtattctgtgttcctattgtgtggtaagcattgtccctgctgtaattacatctattttctcagtaaaacaaagggaagtcttgtagatgaagttttagggcccatcaaaggtagtactctgagtgtgatcaaaccacactttcactatttggagctcagtgagttaggaactagaagagcagagaacagcagaaaagttgtgttttattttcattattattattattattattattattattattattattattattgagacatggtcttgctctttcacccaggctagagtgcagtggcatgatcttagcacactccaacctctgcctcctgggttccagcaattctcttgccttagcctcccaagttgctgggattactgcccttccccaccacacccagctaattttttgtaatattagcagagatagggttttgccatgttgaccaggctggtctcaaactcctcacctcaaatgatccacctgccttggcctcccaaagtgctgggattacaggcatgagccaccatgcccggcctgtgttttcttttaaaatacagcacccctgaatgacctctagctactcccagtccttccaccctcagctggaagatgtgaattgccacccaccaaggcaggaccagcctggcaccgatcactgaaggattgtgattaagtcagatggttttgccagcagcctccagccgatgtctcatgctgagctattgtttcaacaaaaaatgagatgtctggtcatgttctctcttcctggggcagagattggggacctgcgttgaaaaccagtgacaacttccctttgccttactgaagataaaggggaatcaggcaaaaggatgctcaaccaaagctgcaggcaagcggattcccaggcagaacctggtcaaggctttgtaggcatcacttcttctctgagacacagagagcttggcatctctgtgcactttcataatacacaatggttagcattttaatctctggcagcctcatgcaaagaaaaaaattattccaaggcagtgccaggaatcctaatgtcctccatggtatttttccaaaacaattccttaatagataactatcatctttcctatcttacagaagaggaaacctttatcgtcatgtaggtgtgaaacaagaggtacatttgcagggctgccatgaagcattgtcattacacacatttatggtgtgaggaagtgctgttatagtctccaaaactttgaaatcatctcttcttgacttttacttcgactcttttttcaattttaattctaaggttgacttgtattctcggtcccctttgaatagaaccttagatcccccatgtcacattcaaaagacatgtttcaagtgccgtttttcatcttgacatgttttgcaaggtccttgcctctgtgactttgagatctgtttaattcactgcggtgggctgggtaggactcttccagtcttgtgatagtgctgtgttgctggttagatcaatgacatagactctttctgtttaagaataatgcagtaagcaatggtgaatgcttggaatgataactgtaatcatgcacctgttcactgcagttcaaagggggcaaaaacaggtgtacctttgctggtcatcacagcaaaactaatttagtttttttcttctttctttctctcctctttgacaatttgtgtaggggtctgtgcattaaaatggataattttaaggaaattctgtaaaataggtatgcatgagtattgtagaagtatcatgtagtagagatcatacgcaattatttctgtattaattaaagtgtgtccagatacctttaaacaacagttttaaacgttcaaaacagtggaatacatgttgcccaataagtgaaataatatatactgcaatgtatagaacaggtactagctgtatttaatagtgaagttatgcttaatttgaaatgcttcacatttgtttataaatccatcatcagaagcaatgtttgttatgatcaattcagacgtttggaatcaggaggtccagaaggcagccgtaggcagttgtttgtgcattcagactacagagtatcaagaaaatcccaatttgctcagataggtaggtgtgaaaaccaacaatttctttgaaccactcgtcttacaacctcagtgtattctatattgtgcatagatgacagaagaaacattcattcctaagatacctacaaaatgagcaaaaccagcagcataaatggacccagtagtaatctatctccagtgcgtcttaattttgtgcatcatccatttgtgactttcttttgttctttctgttaatcagagatcttttcagtggcaggtgacatatgcccaacttgaatggccttaaggaaaaaaacagtattgtctcatgtgattgaaacatctatgtatatatagctggtttggggcaaagctgaatcaagatgatcagatgatgttgccaggaatacttcttcccacattacacactcttctgtatgccatgtattttcaggctgttcccttaaagtggcaagatggcttccagcagggatacgcttacatcatcccagctcaggagcctgacggcaaagagaaccttctcttcagtggttcaggataagtcccggccagatctcagttgcttacccatcctaagaagcagggttttgttttaactgcactatcaccacgtaattataggagaaagggaaaaggtttcttcaatgagtctttaaaatatttaacattaaaaaattgacactaaaaattgtatattatgtaaaacaggatgttttgaaatatatatatattgtggaatgcttaaattgggtttaaatgagttaaattaatacatgcattacttcccctgtttattgtgtgtgtgtgtgtgtgttgagaacacttaaaatctattcctttagcaatttcctagtatacagtacctaattattaactgtagtcaccatgatgtacaacaggtctgttggatttattcctcttatctaactgaattttttttatccattgactaatgtctccccagctcccctctctccgcactggtaaccaccattctgttctctgcatttatgggttcacttctttaagattccacatacaaatgagataatacagtatttttctgagtttggcctttttttttgagacaaagtctcactctgtcacccaggctatagtgccgtggtgccatcctagctcacagcaaacttcgcctcccaggatcaagcaattctcctgcctcagcctcctgagtagctgggattacaggtgcacaccaccatgcctggctaatttttgtatttttagcagagacagggtttcaccttgttggccagggtggtcttgaactcctgacctaaagtgatccacctgcctcggcctctgaaattgctgggattacagacatgagccaccacgctcagctgtgtgcttggcttcctttaaggcatcttaatgctagaagaagctagaccatgacagacaagtaaaaaagaatgaaaatctactagggtagaggtttttagtgtaaaaaacagagagatgatttttcaaagaaagaactctcctcaaccctctttttacatacaaacttgtagaaaaattaaaacacacagtgaaaacccatataacttttgtgtagtttcaccaatgattaacattttgtgacatttactttctctttctaccctccgtcttcccatatatattggacaatttgaaaattacaggcaccatgaacaactcatgcctaaaggcttcaacatgcttctcttaaaaacaaggcggtttttgcctggcacagtggctcacgcctgtaatcccagcactttgggaggccgaggagaatggatcacctgaggtcaggagtttgagaccagcctggccaacatggtgaaaccgctgtctctactaaaaatacaaaaattagctgggcgtggtggcacacacctgtaatcccagctactcgggaggctgaggcaggagaattgcttgaacctgggaggcagaggttgcagtgagctgagattgtgccactgtactccagcctgggcacagagcaagactgtgtctcgggaaaaaaaaaaagaaaggcagttttgctatacagccacaaaacaattcttatttttttaatgtagatactaactggaacatgcatcgcacttagttgtccttatttctttcacagcttttgatctagaagagtactctcggctgggtgcgatggctcacgcctgtaatcccagcaatttgggaggccaaggcaggtggatcgtctgaggtcaggagttcgggaccagcctggccaacatgacaaaacctcgcatacaccaaacatacaaaaattagccaggtgtggtggtgcacacccgtaactcagctactctggaggctgaggctggagaatcgcttgaatctaggaggtggaggttgcagtgagccgagatcatgccactgcactccagtctgggcaacagagtgagactaagtctgaaaaacaaaaaatgagaaatgcaccttcctccctgcattttttggtcttctatgatgttgatttacaaagttagtcttggaccattttcttgtagaacatctgaaaatcaggacttacttgattatttccctgtcattcagttcaacttcagcactttgtggagagtgctccccaggccatgctgtctcactgcctccttagctggaggtccttgatgtcactttctcccatgatgtgtggcagtaaagttggtcactgggtaactgacaaatttccccaggatacactagtcttgtacttaggaaataacctatgcatctgtactttgatactacctaactatccttttttccatcatcccttcatcattgaggaaccttttcagaatgggttattacactgatagtagtgacatgatgcttttctaattttatcattccatctatattacaaaaaaacccctaaatattggctgtacccactttagtagaaccatggcacccagctagaataccactgccagaaaagaaactatttttaaactatttggcaaaaataacagaactctaaccagccaatgggttctccttgcctgctgcctagacaaagctgttttatcaagacagggaaattgcaatagaaaatatgtgtaattcacccagagccagctgtatgggagaccagcgtgttgttattactcaaattagtctccctgaaaacccaggaactggggtttttcaggattatttggtgggtagggggtcagaaagtggaagtgctgactggtcaggttggagatgagtcacttcctcggtggggtccacagaccagatgagccagttgatccatatgggtgatgcccactgatccatcaagtgcagagtctgcaaaatatctcgaccactggtcttatattttacaatagtggtgttatcccaggagcaatctggggaggttcaaaatcttgcagctcctagctgcaggactcctaaatcataatttctaatcttgtggctcatttgttagtcctgcaaaggcagtctagttcccaggcataaagggggattgtttggggaaagggctgttctcatctttgtttcaaaattaaactataaactaggttatttccaaagttagttcagcctatgcccataaatgaacaaggacagcttggaggtaagaagcaagatggagccagttaggtcatacctctctttcactgtttcgatttcctcagctataatttttacacaggcagtttcaactccacctgtagctacatcatgagcttgaagaaaagaatcaataatgaccacaatttccagtcactcctcttctgatagaaaggccaagaagtagctcttagtcttggttggggatctcttggccaaaaagaaaaaggaaagagaaaagataactgaaacagtgacaactgagagaagaatgatagcgttttgtaagcatcaccattttttcagcgttaaatactcagaatggagtatggggaacttctaagttcacatggcatattcaaattctccttgtttagaatttcaagagctattacttttctttgattcagttcgattatctttcatgatcctcagaaattgtacttttctccccatttcagactaagaaagtccttagccaaatggcctcaaccatcggatttgcctgtaggtgtcattcatttttgttgtttcttcccacctccctggggtttttcagtagtgcttcctttcaatcaaaagctaattttttttgtgtgtgtaggtggtatagaattccatgcttttacacagtagcaggcctgtatttgatgtacctggttcagagacaattgtcctttatagctttcgggagtaaattcaatgagagccccctgcgactagtttgtaactcatttagtgagagttctacaggattatttcacaaagcagttctcagcttaagaagctaaattggcttcatggggcctagctggaggcctcttcatccctgcattcagaggatatttacatgcatactacgaatctttctagaaaatgggaggagggttcgtattgacggtcgtacatttcctcaacttagctgtccgtgaagggtgttgggatgggtgtttgataattagggagaatattttgtttcataatacatggacagctctgtcatattggcaagtgcgtttgacatgcaagaattgtacagttataaggagtgacccgtggcaaaagcagaccatgcatttgcacatttaggttagtatagtgggtaagatgagagactttggagtcacactgcgagagtcccagtgctggactacactttgggaaggtacataacctctctgaacttggttttggcacttgcaagatgtggacaagtataattgtgtgctgggcaggatagcttatgtgtattaagtgctgtgattattcttagatttctttgtctaagagttcgcacactgtgtattatacaataaatacattcataattgaaaaacctggccaggcgtggctgctcatgcctgtaatcccagtgctttgggaggccaaggagggtggatcacttgaggccaggagttcaagaccagcctggccaacatgatgaaacaccacctctactaaaaatatatattttttaagtattagccggtgcagtggtgcatgcctgtagtcccagctacttgggaggctgaggcatgagaatcacttgaacttgggaggcggagattgcagtgagctgagattgtactactgcactccagtctgggtgtcgtagtgagactctgtctcacaaaaaaaggaaaatgaaaaacctttgtgttatgcatattatacagagccctttctaaaaagaacagcagggcgacccctgcctgagttcctggtagagctgggagaggagaccatttatgcactgggagtgacccagtcatttttgtcagatgatagaaactgcttttcttcagtatatctctgtcttagtcttagctgttgtgacacggggcaactctagtatcttctgctttttctacagcttaatttctatctaatttgtactattatatttaattggaaaattgcccagaaagcagagtctgcatttgtaaatgaagaaggagaagcattttaaacgcactaacaaacctcactttttaaaacaagattaacgtcttttacatgaaggaacccttttgaaagaatttgggaaaagacatgagaaaacacatttgctttgtgaactggaattttatatttggaactggcttcacagaagacagagatgttaagtaatatttgatgggtgtctactgtgggctgtatgacttcctaagcatcctattatttaatcatatagttgtaaatataaaacttaacagtttcagacttccatgtgtgtgaaattggagatttggagactttagacacacgttccaatgtcagggtaggacgattgagtcagccagaatttcacatgtatctctccaacttcttttctttctgtccctcctttaacgtctctgcaatatttcaatttcagaaaattgaaagaataataactaccagccattgggctttcttttgtgtggtactaggcagtaagttggacattgcatacatattaattctaagcttcctccatgatggatattatctgcagttgtacatttcttctcctttctcttagctatccacaaagggtctttggatgggtgcttcataattagggagaatattttgtttcataatacaggaacaagagtgtcatatgggagggtgcattttacatggcaagaattgtgcagtcctaagaaatgaccagtggtaaaatggagcgtgcatttgtacatttaggttaggatagtgaataaggtgagagactttggagtcagattacaggagtccatatgctggctccaccatgtaatacctttctttgctttgaagagatatacatatggggaagcggaagttctgctactaagtaatggaatttgctatctgtttagttttgaagctcatagtcccctgagaaatgtcgtgtgtgtgtgtgtacccacctgtgtgtagatgtgcacagagagctccccctggtagatgaaatagaggttattctgttgtaggcaaatgttccctggacattaaaatactggattccagttctattcatccaggcaagttgctgattagctgtttttttctcaggggtttcttgagcatgtgattatgcagagagagtggagatcattggctgggcacggtggctcatgcctgtaatcccagcaccttgggaggctgaggcaagcggatcatctgaggtcaggagttcacgactagcccggccaacatggtaaaacctgtctgtactaaaaatacaaaagttagctgggtgtggtggcaggtgcctgtactcccagctacttgggatgctgaggcaggagaatcacttgagcctggaagacagaggttgcagtgggctgagatggcaccattgcgctccagcctgggcaacaggagtgaaactctgtctcataaaataaaataaaaaagagagtggagatcaccctcttccacgtacccatctctctctgccctactggatctcatgtattccctaaaatgtattgctcaatacagggtgtaagtttaccaggtggtgttataatcagttcaggcactaaaagaaagggttaaaatcatgcggaatcacagagaaaaaataatgatctgcctatcctttttcctgagagtttcctgatgccccaagaggaaatattcagtttggtgatcgcctctttttgatgacatttgccagttttccttgtactagagggagaattgagcctcaggctgacaatgggatccatctagaatcgaggattgtggctttgctttggtcctatttgttttcatttgttgcttctcttcatgatagaattcctggttttcaaattatgctggtaatgtgagtgccctgttcatttgtttttcagaatttaatgtatgccaataaaaaggtgaattgtttgaaggaagtaagatttttacttcttattttacagaggcatgccattcagtagcactggaacagagaggaggagaaactggagagcagaaaggcaggtggcattagcatatgtcagattttcaatgaggactacggatatggcaatattgggaaggtgatctctgaatgatggaaatttaggaaagatgtttaaagtgcttgtctctcattgcctagcgatttactggcattgtagactccaccccaatgcttttgttcaatttggcgtttaggattagtcatgcacgtggaagattccagcctccctccgcccagtgttacagcttggactgaatatttattaactacccagggaacatcacactgtttgaggacacttgagttcatctatatccacaaaatgtgtcctcatcatgttgaagtggaacagcaattcataagaaatgacaggagcttagcaagaatatataggggaaaatcctttgtctagtaagagtgtgaagtgcccaggaaggtgcttccagcaaataatgctgaatgttggtgactgctaaatgaagaaggaaacacgaagttcagatttaacagaaccatctagacagccatacttcccatgaccctgggaggccgacaagatcccatatttaacctatccttaccaatgttatgagaaaaacaagaatgcatgtgcgattataaatggtggctgactttcaattttaggttgagatacaaaagcaggtggtgggggggtctgtggcaaactcggcaataaatgccccaggtgaagaggctgcccagctctcacagattgttgacatgtaggaatcagtgcctctgattttccaggaaaagtcaagaatctaggtttttaatgtaaaagctcctgtttttcaattatgggcaactagtttattatttaaactacttgggctaggaccctaaataagtatgttcaggttgtggattgtacaactcaagggacccagcacgctcatctttgtacttttttttttgagatgtttttattgaggttcacttactatatggtatgcgtatgccacaaaattcacctatttaaagtgtacacttcagtgttttttgttggtttgtttttgagacggagtctcattccgtcgcccaggctggagtgcagtggcgtgatctcagctaactgtaacctccgcctcccgggttcaagcgattctcctggctcagcgtctggagtagctgggactacaggtgcgtgccaccacaccgggctaatttttgtgtttatagcagagacaaggtttcaccgtgttggccaggctggtcttggtcttctgagctcgttatccacccgcctctgcctcccaaagtgctgggattacaggcatgagccaccgcacctggccttccgtggtttttaatgtattcacagagctgggcaatcatcaacacaccatcagcgcattctaaatttagcatatttttattgctccagaaagacacgttgtccccattagtactcacaccctgtacacccttaccccaccctgtagccctacacagccagcattctgctctatctctataggtttacctattctgggtatgtcatgtaaattgaatcatgtaatatgtggcctttcatgtctggcttctttactaagcataatgttttcaagggccatcaatgttgtaccatgtgtcaatttaattcacgttttgtagccaaataatattacgttatataaatatacgacgttgtgtttgtccattcattggttgtcaaacatttggattgtttccacttttcagctattagaaacaatgcttctatgaacattgatgtacaagtttttctgtgtacttacgtttttatttctcttggatatatacctacaagtggaatttctgggtcatatggactctatttttaacattttgaggaacttccaaaccgttttccaacgtgggtaccccattttacattcccaccagcaatgtctctggcttcccttttgtccacatcgtcacgaatacttgttattatttctctttgacaatagccattttgataggtatgaagtacagctcatcatggatttgacttgcatttccctaatgattactggcattaagcatctttttaatgtgcttgttgggcatttgttgtatcttctttggacaaaccctattaaaaaaatacttcgccaacttttaaaatagggctatttgtctttttattaagttttattgttggaaacttttttattaagttttatataagggttttaatggaactttttatttttaagttgtatgtaagggttctatattctgaataaaaattttcaaatcacatgtgatttgaaaatattctgtttcattctgtggatttcctttttacttcttatatgggattgtcagcagcacaattaaaaaatggatacagtccaatttattttttattgcttattcttttggtgtcattttttagaatctgtttttcaccccaaggtcacagagatttactcctgtttcttttttctgggagttgtatagtattagctctaacatttaggcctatgattcattttgagttaaattttgcatgtggtgagataaggatttgcatttgtatctttgcatatggatatccagttaccccagcaccattcattgaaaatcctattttctcactgaattgactaggtacttcttactgactttgaccctagggtgcgtcactgcagttgtttaattgtagaatgtaaatatatgaaggtatattaattctcctactagggaaaaattaactgcaaaaggaggggtcccactcctgtgttcctggcatttttagtttctgcatcagcctcaactctaggataagagatgggtaattcttaatgagaacagaacttcagaataaaagtctcagctggaaaataacttgattttcagtaggcttgttcatatgttgtatatatgtgacttagataatcattataaatacagttgattctaccaagtcttttgaactgtaagtcttagctgggctctgagcaaagcccttcttccttcttggatatacatgcatgcacagccacacacaatacacaaatgtaccctggtggataaggcatttacaattgagaacagctgatagttctatatagtgctatatcgagatagagaaatagctaaagatgtaaatatacacacccttgatacattcatacacacacacagcattaagttaggcagcccctggtttctgccactagcacagctttctgaatgaatgagctctcgagaggggaacttactggaaagctttcttatcaacttggtaaaggtttgattttcttgccccctacagtggctgtttgtcaccctgactgcagctagaattgctgtgttctgttctttttctggagaaattacaaaaggagttgacatctactgtataaaatgaaacctagcaaattttataaattactaaggacgattctctaatcttcatatctcatctccagcatccaaggaggtggagaagtagttgggtgcgtattcacctagactttgttttgcagtaatgtgtgccagttttataccctaaagccatctgagtccccttttcctttccctgtctccattatccatctggataagccagatcttcaatatcctagcctcctttaaaaccagggacccaaccaggcgcggtggctcacaccagtaatcccagcactttgggaggccgaggtgggcggatcacaaggtcaggagtttgagaccaccctgaccaacatggtgaaaccctgtctctactaaaaatataaaaaattagccaggcgtggttgcaggcgcctgtagtcccagctattcgggaggctgaggcaggagaatggcgtgaacccgggaggtggaagattgcagtgagctgagatagcaccattgcactccagcttgggttgagagcaagactccatctcaaaaaacaaaacaaaaccaaaaaacagggacccaattctggctgctgaaacatcagaaagaagtccacaggaaaggtagccaggattttcttccagtttaaaaggagcaagccacataagcagccacctttttctgcactgacagttacctgtgccttgcctttgggtgtggtgttgatccttggagctgccatggccatcttggcaccatgaagtgagtatcctcagaacaaacatttgttgggctaaagagggtgaaacagaaaagtagaaggaactttggtccttaataacaccgggagttgctcagaaagtccagggctgccttttattctggaattcttatttaagacaaaatgatatctttatggttatagtcactttggtcaggtttggttttctggtacttgtggcagaaggcatccttatagatgcacctatacatataccaatgtatccacatccgtgtcttcacacacacatctgtttcctatatgcagaacatgcattcataaatatgtagggttttttaaatgtgatcagacactatatagtttctaacttgcctttttttcattccactatataattaagacatcctttcttgtcaggatctaaaattattatttactcttttaaaagactgcatgttattttatattatgtatggacctgatttatttaatactctcctattagtagatgtttaggtagatgtgaattgattggccagtacaaagtaaaagtgtaaccagtgttataaaactaatgttcttgttatctcccagtaatcctattaatcagtctgtagaaaataaagaggacgtcagaccgatatatacaaagatgattattccaatattaagcataatggagaaacatgagaaacactttaaaagttcaatataaaaggacttgtagtttatgatctatacatatgataaacagtattatgtgaccattcaaaatggcttttaagaatacgtagtggctggctgggcgtggtggctcacgtctgtaatctcagcactttgggtggctgaggcaggcagatcacgaggttgggagttcgagaccagccggaccaatatggtgaaaccctgtctctactaaaaatacaaaaattagctgggcatggtggcatgcacctgtagtcccagctactcgggaggctgaggcaggagaatcacttgaatccaggagatggaagttacagtgagctgagattgcgccactgcactccagcctgtgtaacagagcaagactccatgttaaaaacaaaacaaaacaaaacaaactcctctgtttcccatcccagtgtcagcacgtaaggtgacaactgacaagatctgtctcataatgtgaataatggttttctctgggaggtgagaagatgaatgcttttagattaaaataaataccagtcagtatgttccaaatcacctgatacggtcatttggcgttatccatgtacttgtacaaatttttctcttctaacccacatgtttctactgttctcatccaaagacgtgttgcaaatcattatccagaacatgggtattgataactgcaatgttcttggggctttgcataacttccaataaagcaaaaccacatctctgaatccattttaaatttgcagtcagccaggggtcctctaatggttgtgcgttttggggaaattgtgacctgggtctagtaatgagtctcttccttgggagttaaagtactctgggaacatacaccatctatctcagaatactttgctgaaataagaataacaaggacgcttcaaaaaaatactaagcgacacacctaaagggcttaaacactaataagtgagagaatctagtggctaggaacttcagttctcaagccagtaacaaaactcctaccatttcttacttgcaaaaacttgattttcccccgtgtaaatcaggctaatctttttattcctttactagtgacactaatactattcagcagccatatggcagagtgcttcagaactgctgctgtggagccgaacttctccactactctgtttcccatcccagtgctcaccacctagttaagccatcttgagcaggtgcgtgtaacttaatgcaaccttcagttctgtatttctgaaaggcaattaatgagagcacttagcttagagagctgtgagcattacatgagctaacacttgttaggcaactagaacagcaccctgcacatagtaaatattctgtcagtggtacaaagtgttaacccacaatcaacaaagcattgaacgcagtccataactcacagtaaggtatgcaacatgttgtcctattgccatcttcttcccaaagcccagataactgcaaagggcatctgggtggcactgctgggactggaacatgtagaggaagagggttagggaagcattcatgggtttttcaagctcatttttctcacttcccttaccagacccatcacccaatttagtaggacacagaatcagattattattactttttgtcttctcaaagacacatttttccttgaaattaatggtggtgctgatgaacacgaaatccaccagacagaatctcggggcttttgttctcagtcctcccctacctggttctctctcctcccccatttccctcctgcccagcattgagctccagctgagctactgtcaggaggctgctctgctaagcagtctgtcacatgttccgttacaatcatgttttattatagctttcaaaagatgacctctcattctgcacactcgtgttcatagaggacttctggcattctgaaaagaaccagatagcagagtctccaaaccctttatttgcttcagctgataactgctctggccagagacgaacgctgtggtgattataagatgtaatttactacaaaagaccgttaatattacttacaaacctgccatcatttctggggaaatcagaactgaaacagtggacgggacacatctgaatccacctaaatatcttggcctgatagaattacaagtttatagatttaccatttaggaaacagccccgttatgaaacatttgtcctcacagacagacagtataagtaacaagcaagattatatccttttatgtggatcaaggacatagtcaatgtaagaaaaaaaagatagaaaaaaaatccctttagaggaacgtaaatgctgcccttgtgaattataactggggaattagatctatgaaaaagcctctaatatgactaaacaaagtccctcaggtgatactctgagtcagaaaagtgtgagaaaatatagcctcttaaatgtgattatagtcagagctgcagttactccctgagaaaggacatagaaggtagaggaatgaaagaaaaaaacagtgtttgaaaactttttgtgtcagaccagaaattatagagtagcaacagcttagggatttaagtaacccctttagcctagttgtaaagcctttgggctttaaactgaagaacagaaaggaattagatatccaacttagtacttgtttttttaagatcatgaaatggaagagtcttttttgctgaatgacgaattgaaccagcatataattccaactagggctataattagaaagatacggctctagtatttaagcttcttacactctcccctctctcatgaactttcattagagtttcttgtctacttggttatatttaatggagatgaaggtgagagttacggtgcttttgttggtattgtggccagactccgggagagtcctaaaatcggtgtttgtcatttacctctcctctttgagaaattttaagggaactctacatacaagaagctataccagcgtaaggatcctggaccattctactcatagttttgcaagcaccctatgcttggagttagctctggttaaaggctgtaaaaggaccactgttcctccatcctatccccagtccaatccttgggactagctcgctcaggaactctcagaggtacatattaaaaagaacgtataagaggtcagatctgtaggagaggcttcatcttaagtcattctcccgggtatatttgttgaggtcaagagcaaggaaggagaaaagatatagctgagtttaaccaaagcaaacaggaccttgctcagccaactagtgctgcccgcatggaattgaagatgttaaagagaggggttagagcttgaagaggatgttaaagagaggggttagagtcacagtttgtgcattttaaaggacagtgaccttgactagtggtaatggggtcaaatcattaattcagaccattcagataaacaactcttctctcttgtcaggtaggacaggggatggaggaatgaagtacctagaagcagcttggtaggagaacaaaggcgtcctatttctctcctttccctccattattcatttattccctaagttgtttattggccatttgtctgtcttctttggagaaatgtttgttcaaatcctttgcccattttttaatttgtagtttgttgttgctgctgttgaattttaggagttctttatacattctcggtattcattcctgataagatagatgattggcaaatattctctcccattcagtgggttgccttttcactcttttaatagtgtctttgatttgctaaagtttttaattctgaaaaagtccgacgtattctttttcctttttgttgcctgtactttttgtcctgagctgtttataaggaaaacagcaaaccgtttgtctgagtataggatggtctctctagagcaagaagggaaggcaggtgaatctcatgactccagctggaaggagagaggatcagtctgtgctgaatccccaacagctgacctccaagaggtcttgatgttcttacagaaaggccacctgcaggacagggttgtgtgtgctgctgggaggccaggcggggactcctgggaaagccttctcctggctccagttccatttggctcatctccaaggtggccaggtactcactgatgcatggacagctcatatgttcatctgtgaactatgtccaggctcaagatgagctggaagtgcaattttttttccacttgctgctttatcccttctgtgcattcctcttgctatcatttagcacctggaaaaatgtagaattcaagatcagaaagacaactggagctcatgccccacacacccccaccatcacatgcaaatgaaattactgaggcctggagtgcttaagactctttcccaaatcctgtcactaataaaacgagagctggagattgggaatcctgacttgagccggtgctgttattaccctttttctaatcatcagtgcacccaaggaaaaagaagtttcccaattttatttatttcagtaagtatttactgtcattgtctactcttcatcctagtagcaaaaaaataaaatttgcaagtggaaactaatcatcaccgttgtggtcttagctgaattgttctttacagatctaaagagagaccacagaaagatctgaatggcagcatgccttaagaacaagattgacccagcttacttgtctcagggccaagtatatggcagaactcagtcatctaaaggagagactgaccccggggaaaggcagcccacattgccagagcttctgattttttcaagagaacctggcagttggagtcttgtatgaaatagcttgatgtatacaactaaaggatttaagggaatctgtttcttaaaatttaatatgaaggccaccatctcctgcacaaaacaaaaatctttttgtgttatcaaaatggactgttgatttaagaaccttgctcttgctttagatcagagccctcaaacacattggaatgattcggagagctttagaaaacatgcatgccttagccccactccacactccatgattctgagcctcttggggtaggctctgggcatcagcacttgagaaagcccccccgggcagccgctatgtgcagctgggggttatgcaccactaggctgactgtagtgtgaacattgaggatcctaccccaatcctcttctttcccatgggtaaggacatctggactgtgattgctggacatcaggatggccttaatattagggttaacatctgaatcattggctgccttttttatttctcgtcctgctgtttgggtactttatagacatagacagttgtccatgtgaccccatttgcctcgagttgcttctgtagagttttgatcccacactttgtgatgtgtctcagctctggggcgagggggctgttcagtgaagttggtttgtggcttcttccctctgatctccttttcttctcccagccttgggggttctgcagctaactgtggtcctttcatgtagctgcctttggtctgctggggactttgaaggtttgcctttgaaacacccagatccctttttggttccttcctctaccccatctgcttctctccactccccttactgttggcagcatcccctcgccttggcagtccagcttttgagagtcactgtgatcaacccagcaattcctactggggaaaaaaaaaagaaaaagtagggagccatgataggtgcaccatgtctatcaaagccatcaaaatggctattttagaaaaaaacctcaataaatattattgttgatcttgttacacatgataacagcattttcttatttttttaatttattttttttaagagatagggccttgctttgttgcccaagcaggacttacagtcttgcatttaagtgatcttcccatctcagcctcctgaatagctgtgcattcttgttatataagaaagtatctgtaatttttagtggcacaattggattataaagtagaggttaaatgataggaactctggagttgcttcaaatactttagaaaataaatgaataggtaaatagcaaggtaaagcaatggtggcaagctcttaattactgttgtatatgggtactgagtatataaaacccattatataacatgttctacttttgtgcatattgaaactttttattaagcatatacacatgcacacacacgtataattgtcagccctataacattctacaattcaataggaatatatgattccaagattctataattctttctttcttaccaattaattggtgcttgagattgatgtaactgaatgaatagatgacttcataaaaagtaaatgagcttgggcctggtggcacacgcctgtaatctcaacagttttggaaccttaggcaggcaggttacttgagcccagaatttgagaccagcctgggcgacatggcaaaacctcatctttaccaaaaaaagtaaaataaaattatatataaatataaatgtatttatagtgtgtgcatatatataaaaatatataaacacatgcacaacgtgtgtatttttatatatatacacacacaaattagctgggcacagtggtgcgcacctgtagtctcagctactcgggaagctaaggtgagagtactgcttaagcccaggagctcaaggctacagtgagatgtgatcaaaccactgtactgggtgacagagcaagaccctctctcaaaataaaataataatttataatgaaaccaacacatacaattaaagaaataaaaaataggccaaatagcatctatacttcaccttcccaacatgttagcttttacaggtagctgtctggcatttgtttcattgctgtccatctagtttggagttttgctttattgatttatgatattatcaagcacagactgtgaactggatcttatattgtggcaatattagctttctggctgctttgaatttgcagtcttaacccccaaagagagaaatcagaaatgacagcattttggccaaatacaagcgtccagtgcatttgtcatcggagtgatcggagtgaatctctcatttttacttgtgctgctactttacatgtagtgacttcaagtacagagtgaaaacttaatactcgttcattgttccagaaatatttattgggtactggctccccgccaggctctgggcagggcctagatgctgtgtcagcgaacaggagagattcagtccgtgtgttcgtggaggttgcatttagacgggcatttcattatgaaacaacacacgggaaactatacttgaaatatgcatcctggcaggccacagtggctcactcctgtaatcccagcactctaggagtctgaggcgggtggatcacttgagggcaggagttcgagaccagcctggccaacatggtgaaacctcgtctctactaaaattacagaaattagcggagcatggttgggggtgggggcagtgcctgtagtcccagctacttgggagactgaggcaggaggatcacttgaacccaggaggtggaggttgcaatgagccgagatcacgcccctgcactctagcctgggtgacagagcgagactctgtctcaaaaaagaaaaaaaaagaaatatacatcttataatgctgaatgtatttccagtaacatgcaagtgttgtggggagataggcagagacttggacaggtaatcggaggctaaaataggaatcctgtgaagtactactgcctttgatattttttccaagccaatatattagaaagccacttcttcctggaattcatgtatccagacacatttttatcttgatgaatttggggttgcatgtctcaaaaatgactgtacgtgttttaaaattttatgttctggggtacatgtccaggacgtgcagatttgttacacaggtaaacgtgtgccatagtgatttgctgcacctatcaacccatcacctagttattaagccccatacgcattagctgtttatcctgatgctttccctcctccttcccctctacgaggccccattgtgtgtagttcccctccctgtgtccatgtgttctcattgttcagctcccacctggaagtgagaacatgtggtgtttggttttctgtgttagtttgctaaggataatggcttccagttccatccatgtccctgcaaaaaacatctcattcctttttatggccgtatagcattccatgttgcatatgtaccacgttttctttatctggtctatcattgatgggcattttggttgactccacgtctttgctacagtgaatagtgctgcagtgaacatacgcgtgcatgtatctttataatagaatgatttgtattcctttgggtatatacccagtaataggattgctgggtcaaatggtgtttcttgttctgaatctttgaggaatcaccacactgtctttcacaatggttgaacaaatttacattcccactaacagtgtaaaagcattcctatttctccagagccttgtcagcatctgttgtttcttgactttttaataatcgccaaaaatggctatacattttttaatatacctgaggctgctgccttccaaacctactgactaatagtccctgagagtggaagtcagcactctgcattttagcaagcttcctagagaatttgtgggtgaacagatgagtgttcatctgactactgattggggacaatgacagaaagatatcagaatgtgctttgaaccatcttggaacaattcattgtggttattaggattaaaagggaagagaaatgtcagctctcatattcacatcccttaaaaatcaagcattaggatataataattcatttaatataaatgttataaccatatgaccaatttccagttatcataagcagttaggtctttcagtctctctcctctctctctctctctctcgctctctatctctcttcctctctctcttcctcctctgtctctccttactctttcttcctctctctcccctctcttctctctcctatctatctcctctccctctttcttcctcctctttccctcttcctcctctctctccgtcctgtctccctcctctctctctctcctctctctttctctctcttcttcctcctctatctctcctctctctttctgtcttcttccctctctgtattatgtctgcctatgtgggcatgtgagtgtgcaaataagaaataattattttagaattttgtggtttccccctgctgtatatggttccaaaattcagtgtctacaacatagctcccgaataatgtttcacatcctaatgagcgatcatagaatgggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcctctcataaccacactccaaaaaaaaagtaaggtgaagaaaacaaaataactcacaggaggtagggatgccaaagaaaggtaggggactcaaagaaagaagtcaagatgaaaagcctgctgtctttatttgcataatagtttggttggggatcgttttgtagttgttctggctttacagctttttcctgcctaagaagatatttactgtcagagaaaatatccccttaggccccctgaagattcctccaaatgtttataaagtcagcagctctgccctgcaacctacccaactaaggtaaactttactcccttggttgaagtgatttgtgttgagattttacttagtttacatgcgttgtttgctgtttgtatgatttcaggtgaaatagctcttacatcgtgagtcatcttcatatttaggttgaaaccatagacttttcggaatattctttgccctgaagcatctctgccacgctgaaccttcttaaacacatattaatgaaatgtctcctcaaatgatcacattcctagtaagtaattagggcttagtaattaaaacatgcagtcatttgagacttaaattttgaaggcacagaaagattgagaaatttaaaaagtttacggacctgatgaattggatactcttgcataggacttggtgctttcggtattttttgcaaagttatttgctcccatctgctggccatttgtgatattgcaggtgctgagctaatttgtgaatggaaaaggaagtgaataaaatctatcactgcaaacattttatactattcttcatgtattcaagtaaactgatttgaatcttggtttttgtttgtttgttagttttgttttgttttgttttgtttttgcggttggaggattaagtgaacacagactctgaagaattctgctgaaaggcaagcatgatttgaaatttttaccaacatcagagttactcaagttttgaaagccagaacaccctcgttatctttaataaagcaattaactttagaacattggtttaaatattcaaattcaagcacagtatattgtgtaagggagagtataaaatacatagctcgtagaccagatggatttcaatctcccttatgcttttaatcatcggagtggtaggaagccaattccctacactctaaaactcagttttttcacctgtaaaatggaaacactgggcaaaagggtccctaaggcttgaacttattctcaaaatctgagtctttgtgaaggttaaaaaatcatataaggctgagcacgctgggtcatgcctgtaatcccagcactttcggaggccaaggtaggtggatcacctgaggtcaggagtttgagaccagcctggccaacatggggaaaccccatctgtactaaaaataaaaaaaatagccagacgtggtagcatgcacctgtaatcccagctactaggtaggctgaggcaggagaatcgtttgaacccgggaggcagagtttgcagtgagccaagatcaccctactgcactccaacctgggcaacagagcgagactccatctcaataataatagtgtaggttgcataaaatcaccagtatgctcttagtcttagcatctaaactcatattcagtgacttgtcttaaattagaagccgttgttattttcacaacaataggcaatgtaagcatgcatccaaactatcagaaagcttgcctttgcaaaggagaccatctgtaatgttgagtcaagatttaaaatgcaccttgaatgctttttggagtgtgatgtcaaaaatgtatcttgtgttaatattataaaccgttctgctataacatttatttgctgtttaagaaggaagagcaaaaccttcttcctcagcagtaatcaatttctcagttgatcataagccgatttgggcttgtcagatgaacctttgactgtgtctcctcacactcctgagaggtggcttaagctgtcctgtatttcctatgaaaagctctctgggactttgtatttgagtccaggagaacaatgctgtgcccaggatatgtgatccttacttagcttctcatgacaagtctaagcatcctggtcttttctttccattgctcttccagagtgaatgactgcaataatcaatttagaggttttcaggggctgtattgtggaaacacctgggccctggagcacagcagcctgtgattgccctgggattccttttaaggaatttttcttgtcccctagagcttagactaagcggaggtggcctctggaccacagttatcttttttcagtattaagtagccaagcatcctgcaagagagatcagcacaaagagctccttgatcctctgtatttattttctatgacttccgtagcaaatcatcacaatctaggtgcttaaaacaactgaaatatattctctgacagctctggaggctctacgtccaagttgaaagtgtgagcaggacggctctcccagcaaaggttctggggaagattcatctttgcctcttccagtgtctggtagcttagtgtcacatgacttgtagcagcatctctctaatccccacctgtcttcacatggctttctcttctgtctcttaaaaggatacttgttactggatttagaacccacccagataatacagaattttctcatttcaagacccttaattatgtctgcacagactccatttgcaaacaaggtcacattcacaggcactagggactagtcggcttgagcatatcttttggggggctgctgttgaaccccgtgctggctactcacttctaaatcctctgaggtctcgggagcttcgttgtccggtgtttctctccacattttctcgggaatctttaagtgccagatacttcagagctgggaatgctgctggtaagggatccgggatgctggcatccttgcattgtgggcatgaataaccctgacctacaaaaattatcaaaaacaaccaacacaccaagtgtagaagaaaagaagtctctctcgggagagagaactgcttctgaaaagaacggacacatgagtgctttgatgtctaaaatctcaaagaacctagaggccttggaagagaaaactttaaaaatagacatgtttttaagttctcaatgcttcaatcagaaccaggtttcacaaagcctgttggaagatgtcatcaaggacagctgacatttactgataacttgccatatgctaagaccctggcgtgtattggatatgcctagccacaaacgaggcaaccatgattgttaatatgcttctcttacaaatagggaaagtgaggctaagcaaactcggcctccttgtgcagagttccaaaactggtgtggttgagtccggtaggataaaccctagcagtgtgattctgctatctgtgtggaatcccatctgtcgccagcaagtgagcctccgctgttcagggtttcccggctacaaaaagtagaagggctgccttctgtcgggaaattgattgcttggtgatgagtccacagctcaaaattcatacttaacacttttaagtagttgagctgttttccaagcgaagtggtcgagtggggctgaagtacttacttgacgagtctggttcagaaaaggtcaggtcggaacccacccagagacaccggctctaggcagcgtgatccgaacaataatttgttctcgccaaagtgacatttttccaatttgagtccagcattgttcagaagcaaatgcagtcccctggggcgcctcccgcatagatctgcagcagatgacaaactaacaatatcatctaaataaaaaatccagcatgggtttagtaaattaatcctgacaagaataaattgaataatcttagggaaatggcgagagctctgattctgccagatcgctcttttctgtcgcttgcgtgggtcctcggtggcagattaagagcaaaaatctgcctttggtttattgatttcgttagttcgttgattaacacctgccacttctgtgtgggtaaatcataatcggatatggactcttcctggcaaacttaacatattttcactcaaggagagaaaggaaatgcttatttcacctggtcagaacgggcaaaagcagacagagagctgcttttcctcacctcgtttctcagtggtattttctaggtttaaaagtaatctgtgattttcatcactcccatattgagttaatctcccgtttctgtttaggttgcttagcagacaaattcaaggagagtttttagtaagagtgaggggtgtttttcctgactcagtgtccgaagtcaagcagagacttcagccattaatttaggagacagggtgagaaaaggaagataccgcgtgtacacatgatcccacgtcctaggactgggccttacaggtcgtctgggaaccttgtcttagtcagcctgggctaccctaacaaactgccatagactggatagcttctgaacagaacatttactttgtcatagttcttgtgtctggatattcaagatcaaggtgccagcagtgtcaggttctgatgagcaccctcttcctggcttgtagtcagtcattctcactgggtcctcatttggacattcctgggcttacgctaccagagagagagagagagagaaaatgagtgagctctctggtgtctcttcttaaaaggatactaattctttctttattttattttatttttgagatggaatcttggtctgttgcccaggctctagtgcagtgacgtgatctcagggctcgctgcaacttccgcctcctgggttgaaatgattctcctgcctcagcctccaagtagctgggattatagatgcccaccaccatgcctggctaatttttctattatattgaaatccaatggggtttcaccttgttggccacgttggtcttgagcccctgccctcaagtgatatacctgccttagactcccaaagtgatgggattataggcgtgagccaccacacccagccaagggcagtcattcttaggacctcatttaaccttaatcacttccttagagttcccatctccaaatacagccacactgagggttagagctatgacatatgaattttaggggggacacatacattcagtccatcatactacgtgttaaaaatgttgattctgattcgatgtatctgggatgaggtgtgatgtgttgcatttttttttaaagatgggatcttgctctgtcactaggttggaatgcagtggtacaatcttagctcactgtagccttgactgcctagggataagtgatccccttctctttgttttgaaacagagtcttgttctttgttgcccagtctggagtgtagtggtgcaatctcggcttactgcaacatcagtctacagggtttaagtgattctcgtgcgtcagcctctctagtagctggaattacacgtgtgtgccaccatgcccagctaatttttgtatttttagtagagacaggggtttcattttcttgcccagacaggtctcaaactcctggcctcaagtgatccacctgccttggcctcccaaagtgctgggattacaggcatgagccactgcacccggcttcaagtgatccttccatttcagcttcccaagaagctgggaccacaggtgcataccaccccacctagctaatttttttcttctttattattattttttttgtagagacactgtctccctaaggtttccaggctggtcttcaactcctggactcaaacgatcctctggactcggcctcccaaagtgctgggattataggcatgatgcattttaactggctcccaggggcatcgtacttgctggggttgcagactccacgttgactaggaagttcctcatactccccttatgtgcggatgagggaaatttgctgaaggaccgcatggttattaaatagtaacaccctgctttaagagtctagtgccgtgagtctaatgccaggagtctaatgccagaactggaattacccgcagccctgtcctcccacccttcagccttcagtccactgccacatcccctggagggcttggtagcatgcatcgacgggccctcaccctttgaattttggattcagtaactgagggctcttccgtgcaaacctcatatttttcacttcaggagagaaaggaaatgcatcacctggtcagaacaggcagaagcagacagagagctgctttttctcacctcatttctcaatggcattttctacagaaaatacagcctgagaatctgggtatttttctttgcttatttatgtaaactgacaaaagttatatatatttatcatgtacaacatgatgtttggaatgtgtgtacattgtggaatggctaaatagagccaatatcatatacattacctcacaacgtcatttttttgtggttagaacacataacatctactttcttagcaattttcaagattacaacatgttgtgaactgtagtcaccatgttgtataatattttaacttattcctcctgtctcactgaaattttatgtctttaggcccagatctccccagcaaaccccctggtagtgagggtagtccctgccagcccttggtaaccaccattgtactttttagtatattttttgtatttgtttcatgcagtatttgtctttctgtaactagctcattcaacttaacacagtgttctccaggttcatccatgtcatcacagtgacaggctttccttctttattaaggctgaaatggtattctgttgtgtatatataccacatttgctttatgtggttcttccttgatggacacttagttttttgctttttgttttatttcagtaggtttctggggaacaggtggtgtttgattacatgaacaagttcttcagtggtggtttctgagattttaatgcacccatcacccaagcagtgtacaccgtacccaacgtgtaatcttttatccctcaccactccccgacactttcccctgagtccgcaaagtccactgtaccattcttatgcctttgcttcctcatcgcttagctcccacttatgaatgagaacatgcaatgtttcgttttccattcgtgacttgtttcacttagaataatggtctccagttccatccaggttgctgtgaatgccattatttcattcatttttatggctcagtagtattccattatatatgttggggaagtattttattacatatgtatatataagatgtagtattccattttatatatgtaagtatatgcatgtatattgggtaagttttctgttatatatgtatagtatattatatattgtattcatctatgtatagtattccaatataccacactttcttttatctacttgtggattggtgggcctttgggctggttccatatttttgccactgtgaattgtgctgctataaaagtggggtattcagtttgattccctatcttggctattgtgaataatgctgcagtgaagaaggaagtgcagagatctctttgacatacggatttcatttcctttgagtgaatatgcagtagtcggattgctggatcatacagtagatctgtttttaattttttgagaagcctccacaccgttttttgtaataactgtaagaatatgcctttttaacagcagctgatgctgctggttggagagtctcactttgagaagcacatgtaccttgcttctccaggtttttttgtttggttgcttggttttatttttatttatttttttctttttttgctgtgaataaccccttcttcccatagcaaggaaaagaatgaaacctgtggataaattatgtggactgaccaaaccaccttgaggaaaataaaattacctggaggaaagggaaagcacctgatgagggatcacttctggttacagatttaagctccctcattgtgtgattcagtatgagttacctaatggctaatcacaattatcatgccacagagtaactaaggaatacccactttgtcgaatgttggtaatttagagacagtacgaaaaacaccaagcacagttcctggcacgaaagaggtatttaatcattgctcaccggttcagtcccacttgactgataggaaaacagtctgttctacataaaacaagatatttgctatacgagtcttcaccttatgatattgtctctttttgttccactctggattcaaagggacctagaatttgctgtgtttactaataaatcaccagcttctcatattaacctttcctaatgatgcatccgcagagaaaaccccactgcctcttggtgagaaaatcaacatttctgtagacttaaccacaatggagtccctaatgttttttggttgtttaattgattggttggttgttttttggaaacagagtctcacttcgttgcccaggctgaagtgcaatggcatgatcccggcttactgcatcctccgccttcccggttcaagtgattctcttgtctcagcctcctgagtagctgggattacaggcgtgcaccaacaagcccagctaattctgtatgtttagtggagatggagtttcaccatattagccaggctgatctcaaacacctgacctcaggtgatccacccgcctcagtctcccagagtgctgggattgcaggcgtgagccaccacacccggcctggaacccctaatgtttgtaactccctacacaaccctgcacatccatgccctccctgcctccatggagagcatggccaggctacagaccgtgcaacggccccaggtcgccatctttctctcccaagctgtatcctttctttaaagacgtcccattgattttatctggcctctgactacttctctccccttcccctgctacacccttatccatccaccatcatgtcacacctggactcctgtggtagcccccaaatttttctccctacttaaatttgtaacccctgactgccggttctgttaaaatagaagtcagatcatgcctgtcctctcttcattatgcctgagtgaaacccacaagtgcccatgaggatgtggacagattggaacacttgtgcactgttagtggggatgtaaaatggtgcacctgctgtggaaaacggtagggtggttcctcaaaaaatgaaacattgaattaccatagggtttggcaatctcacttctgggcatacgcacaaaagacttgaaagcagggagttgaatagatacgtacacacccgtgttcatagcagcatcattcacaatagccgaaaggtggaaacagcccaaatatctatccacagatggcgcttatgaatggataaaccaaatgtggtctctccatacaatgcaatgttattcatccttaataagaatgaaattctaacacatgctaccacatggatgaaccttgaagacattatgctaagtgaaataagccaggcacagaaggacaaatgttgtatgattccacttaagcaagtgttaagtcctcaattgtataactgtaaaattcatatactgaagtcgtaacttccaatgtgattgtgttttggagattagtcctttagggaggtaattcaggttaagtgatgtcataagggtggggtcttaatccaataggattggtggccttaaaagaaagatggccacaccttacggtggctcacacctgtaatcccagcactttgggagggcgaggcgggcagatcactaggtcaagagatcgagagcatcctggccaatatggtgaaatcccatctctactaaaaatacaaaattagttgggggttgtggtgcatgtcggtagtcccagctactcgggaggctgaggcagaagaatcacttgaacctgggaggtggaggttgcagtgagccaagatctcgccactgcactccagtctggcgacagagctagactccatctcaggaaagaaaaaaaaaagccatgggtctgtctccctttctctctctctcagaaagtatagagcagcagctatgtgaggcaccatgagaaggaggcatctacaagccaggaagagggacctcaccaggaaccctgagagagccttgaccttgaacttccacctgtagaactctaagaaaataaacttcagtcgttgaagtcacctagtctgtaatattttttatggcattcctagccgactcatacaatgagaggagtctagagtagcaaaatccacagagacagaaagcagaaggtggttttcaggggctctgggaggggaagtgaagagttattgtttaatgggtacaggtggaaaaatgaaaaaattctggagatggagggtggtgatggttgcacaacagtttgtatgggtaatgccccagaactgtgcacctaccatggtaaaattgttaatgatattgtattttatcacaataaggtaataaaactctgagtggtttctcactgatctcaaaataaagtaaacatctccctgtgatctcattcccctttattttcctctcttacttccctctaaccacagtggcctccttcctcttgcttggctctttccagtgcatttcccccttggggctttgaacttgctcttcgtttgcctgggatgttctcttccccagtgggctacttggctcatccccctaacttccttcaagccttttctcaattgccactttttcaaaaaaatcaacatcaacatcgtattcccctaccctcagcatttcccacccccttctccttggtttatttttcttcatagtacatattctttctggaataccattaagtgatatgcatggtttaatgcttgtcttgtccagaagaatgtaagcatcaccagggcgggcctgccatgtgtcttctacattgttgagtcctccatgcctagtgcaaggtctagcagccaagagttgctaaagaaatatcttccatttgaataagttaatgccactattgcttgtgggactgtgtctgtcattttgtctaattaatgagttccctgagggtaggaattatgtttgtttcaccttttcgtaccaggacaacaagaaaatagcagaaaatcataggtgtgcaataaatatgaatgagtggatgagtggaatggtagatggatgggtggatggatggatgaatggatggatggatgaatgggtgggtggagggatgaatggagggtagatgaaggaaggaaagatggatgaatagatgagtggatagaggatggatagatggatggatgggtgggtagatgaatgggtggatggatggataggtgggtggatggatggatgagtagacggatgaatgggagaaggatgcaggatagatggatgattggatagatggggatggctgggtggatagctggatggatgaatggataaaaagatgaatttgggtggatgggcgagtgtgtagatgattgatggatagagggtggatgaaggatggatggttggacggatggatggatggatggatggatggatggatggatagaggaagggtgggtgggtcaatgaatggatagatgggtggatggataggggaaggatgcaggatgaatggatgattagatcaatgggcatggctgtttgggtggatggatggatgggtagaggaccaatgaatgaatggagaggagatgaatggatggatggttggatggttggaaggataaaaaatagatcctgataatttgtgttgaagtgagacatatctgactatcctaaattttgaatgggagagatattaaaggcagtctctgctgatgtgaacaattgtatggagggcagattattttatgagctatcagttcctctttgctgtgacctctgatccatagcctttgcctacattccacatctgcatgtaataaaacttacttatgagatacatatgtctctaatgcaaacaccgcagtatgtacctttaaaaagcactataaagagcaatgactcgagaaagaactattaggagcatgagctctttattattttaaagggcatttcaacaacaccactgaatgttctctgaccataagtctgactcctgttctttctctcactttcctttcttttcttctcttctcaggatatcaaagcagactgcaatacctgcgtggaaatagaagacagaaaggtgagtcaatatttttcatttttagggttgcaaacaaaacaagaactctgtgaattgaacccaggtgtttaaggcatgcccctctcgatgatggtttttaggtgattcacggtctatgacatatttaaagacaatcagacttaaaaatgcttgtcattttactcctttacaatctgtgttacttctgatggcttcatgaggagtgcatattgtaattttttacaaaaaatgtggtgctgatttctgtttcagtcatacccttcttttcaggaaaatactttaacacttgtcacattgaacttgaatattgatgttgacgttcattgtgtgtatcatatgtataattaattatattattacttacattatagaatatataatattaggcttcccagggtgtgtccctatatatctgactcatacacttgaaaaagagctcacggccaggtgtggtggctcatgcctataatcccaacactttgggaggcagaggtgggtggatcatctgaggtcaggagttagagaccaacctggccaacatggggaaaccccgtatctactaaaaatagaaaaattagccgggtgtggtggcacatgcctgtaatcccagctacttgggaggctgaggcaggagaatcacttgatccttggaggtggagactgcagtgagccaaaattgcaccagcgcactccagcctgagtgacaaaataagcctccgtttcaaaaaaaaaaaaaaaaaaaaaaaaaaaaaagagctcgcgctcaatttccatcacaacacatcaacacattcatatgagcaacagcgtcctatctgagattaagggggtagggggcaatgccattttctacatatttagagtcccctcacccatttatcttctttgctacacttaatgtgaatcccctcaggaaaagcaaccgttagacaattgtttgttaatattttcacagtctctttttattgacaagagttcacagacatttctgcagcaaagcacatccaagaagatcagattttaccctgtgtatgccttggatccaaagaggtcaaataagcaagttaagagtacatacctcctggctacttttgacatcgttccacaagtttgaaagatgtttctcctttcaagtgtaccattattgtcaaatgggttattatttcaagcagaggttttcagctctgattgtatcatgactggggcatgtctgctgattaataaggtggtggaggacttctcaaaacaaaaatttgcttttaaataaaaagcagttgccacacattattttagggagtgttaatctcctcacattgggaagaataatgatacagtaagttcaattcaatctgcgtgatcccagcttgcagttttgtgttgctctagtttgctggcaaaggaatttcaattcatgtttgcattcaccatgtgtttgcatgctggtatatgcatgtgtgcatttagtgagttggacagatggaattgctgcttaggtgaagcgtgtgtccaaagtcttctaccaatgttctgcccagccgaatcattccgctcatgtcagagtgtttagaaagcatgttccccaacctgcttccaaaggtcattggcatttctcttggacttttatggaattcatcaacatgttttgtccggtatcttttttaaaaatttaattgccaatagtgcttgaaagataacataggaactgatgctgttagaacaacctgagctccatcacgcacaaggtaaataagcaggcagggtaagctctgggcaaggagagtcacccaagctccactccacctatgtgaactgcctttggttaagacatcatgatgatggcaactgccctggtttctggctactctgtgatgcatcttggtgggaaaaagtcattaatggtcatactgtgcatatgtgatttcagctcttctcaagaaaggggaaaatagacacacacacacacacacacacacacacacacttctagttttttcataaattgttggattgagtcaataatgtcaaatgaagccttgtttctgatgagttttcccatttttttctaaacttgacctcatatgactgatagataaatttctaaacaatttgttgcagttaattggtgatgcatcttagtgataagaaaaaataatgcccagttaaaattctcagtgtcttactctctaaggactttttttaaaaaagagtcttttaaacaaggtaactcctctcctctcctctcctcccctcaactctcctctcctcccctctcctctcctcccctctcctcccctttcctctcctcccctttcctctcctctcctcccctttcctctcctctcctcccctttcctctcctctcctcccctttcctctcctgtcctcccctttcctctcctctcctcccctttcctctcctctcctcccctttcctctcctcccctttactctcctctcctcccctctcctctcctctcctctcctcttctctcctcttctctcctcttttcctccttccctttttctctcctcctttccttcccactttctcgtcttccttcctccctccttccttccttctttttccttccttcaaattcccagtaatacagtgaatcttatactcacgctatagtttctctgtttctaacaattgttaagaagagattgggagtgaggttttaggagcttgctttatatatgggagacatttctcttaattgaacagtcaagaagcaaacgctaatgatccctgagggacggcgtgcccctcaccccagcagaacagctccatccccctccctctctgcttggtgatatggtgtgaggccacacagggagccattggctgtggcagccagagtgattgccgtcaggttctgggagtgcactctggtgcctctgccacactgatgggttgtttaggaaatttcaccactggagtgatgacagttgctcacgcacgtgtgtgtgtgcatgtccctctccatttaacccaaatgcttctggcaaaatcagtaatttgataaagtggaattgaagtgacaagagatggcagaggtgccaaaataataagtaaacctgtctctgaagcggcagcctcttggcctatgtggatttttacgactgttgagagctctgaaagagaactggtggtgctttctttaaagctctttttattttattttattttattttactttagttaagggagcttcacagaacccctataggatgtgatggcttctcaagaatcactttattttttattattttttatttttctttcacctcccctggctttctgtctacttcgtttccagatattccacatatatggatatatttgtgtacctcgatttatagctatgtatattgttgaatatcttcttgatagaagaattttagaaaagacaaaaccttaggttttccatggagtcctacggggcctctccaaattgtgcctcattcccattctcttcctttcaatggggccgattatcttgagatgaatgattttcccactgaatcttagaccacatatcatgatagaagataaactgtgaatttcaacagtggaagagagccttcatttttttttttttttaacagtctccctctgtctcaaatctggattgcagtggtgtgatcgtgatctcagctcattgcaacctccgcctcccgggttcaagcgattctcctgcctcagcctcctgcctggctaatttttgtattcttagtagaggtggggttttaccatgttggccaggatgatcttgaactcctgacctcgtgatccgcctgcttcagcctcccaaagtgctgggattacaggcatgagccaccacacccggccgagagccctcatcttgttgtagagcaataaaatcattcttctttatctgcgcacagtctgggctcgatctgagactcttcatagaataaaagaatttttatcctctcctgtttttctatttttctttatcccagaagcctattttctctcaggctgacaggaaactaattgccatttggaaaaccttgcctggctgtttatggggaaattcataatgtgtattggagtgtggctttatgtttttctttcgcttccaagcccgccaattagcagagcccctatgaatgtacctgcttggatggttcctggccattgcttaaactctctcagagggtgtcctagggagatcctaagggatggtggagtttttcaccctttaataggaagcaggagcacaggttttttgtttttttgttttttggtttttttgttttttttgtttttttttttcctcctgcaggtgaacgttgtggagctaatgcagatttagcaaaggtgacgggaggtaacccatcacttggagtggctgtatggcctcacaaaacccgatgcgtttgacatttacagtacctgtgtttctgctggggcactgaagcatttaaattcatttttatttgtggtgtaaaatccacctgaatttcaatactattataaagactgagattcaggtgatgagaggagaggctgatggatcagtcagggggagaatctgtcaagaggagacgagagcccattttataaacacagacagggcttcctcttctcacttatcgcctggcctggtgcagctaaacagtttcagatctgctataaaattgcatgaaaggagtttgagtggttttccaagttatggcgactttcagattgggtccaattgaaggtgcgattgggagatagctttcgtgctgtggttaacactgagagttctgaactcatctttttacaatacttcttccagatcaggtatcttaagtaccgccgaatacttaaaacagttgtggtgtggaagtaccatcattttccctgttttacaggtaaaataaaggaagctcaggcacatttaagtgacttgcctgagatcactcaagcatgagaccaggatttaagctcagagattcttactccagagtctgtcctcttagtttcaatactaccctgcttgcggttttcaatatggggcaggctttcagctcccacattgcagctctagctggttcacagtgaggattcttcacagtgtttacaagcctgcccttccgggaagtagttggcacccaacagtggggtggtcagatgtcttctggctttgagggtgagggacagtagcactggaactggagtgctgacctcagtttccaaagacctgattcggttcctaggtttggcaatttcagcagagtagatacacgggttagaaattattgcttaaagagtattagggaggctgggcactgtggctcatgcctgtaatcccagcacttttggagggtgaggcggcctccaagatcaggagttcgagaccaccatggccaacatagtgaaacatcatctctaccacaaatacaaaaatttcctgggtgtggtggcacacgcctgtagtcacagctacttgggaagctgaggtggagaattgcttgaacctgggaggcagaggttgcagtgagctgagatctcgccattgcccttcagcctgggcaataagagtgagacttcatcttaaaaaaaaaaaaaaaaagcaagaaattcttgcttaaagagtattacggaaaatagctaatgcatgctgggcttaataccttggtgatggattgataggtgcagccaaccactatgacacacgattacttatataacaaacctgcacatcccgcacatgtaccccagaactaaaaataaacataaaaaagtaattcttgcataggtaatggttagtagctcagacaaattaagtcacttgcccaggattattcaggacgtatcatgaggccacgatttgagctcagagattcttactccagagtctgtacatagcctttggagcttgaaatgtctgggtttcaatcccagccctcccaaatagcaactctgtgaccttgagaagctttcttaccctgtatatatcttcatctgcttatctttaaattgggagtgatacaatctgcttgaaatattggcttgagaaattcataatactgcaaatcattttatataatacctggcacaaaataagaactggattaactgtagctgcggttatttttatttttgctggtatccacacctacaggcctaccatgtcatttataattacatttattttatcaaatgaggccctggaaagtgttaggggatctcaggggagtatgcaaccaatgggacctagtaggccttggaaatatttcacaaaggaagaggatccttggtgtaggtcaggaaatacaaatgcacctgcctgccaagtccaggtaggaaataatgaattaatgaagaggcagaggagtgattgtctttaacgtgaagtcctatgtactgcagcgacctggaaggtgataccttcatatcttgggagctgttattcagctaaatgtggccatgtggaatatagattcagtattgctgttttctaagccaatctgaattttcctgtaataccactgattttttacttactatgagcaatccaaatgaagcacacatgcagaaaagtttcaagagacttacaagacttgagtgttgaaagctaactctcagtgggttagaaagagctcccatgtgcctaattccaggctctgtcggtctatgaaaggccctcctggcagagggaacagaatggcgaggacaagacggtgtagagaacatggtatgtttatggcgaatgcaagtccagtgtgtgtgtctgagattggctaaaggagagactacagcagtgagtaggtagcaggttatggagggaatagtttatcaggccaatgcattagggttctgtgtcaatcctctgtccccacagaaggcaaatctttactgtatggggccagagttacacagcaccaagaaggtacttaaactagtatgaagaacccagccaaagtgaaagtcagcaggggaataagaactggggttggagcccagagaaagacccagagactggccctgggtgaatgcaggaagctgaacactttgattcgagcaagacgaagtcagccaggaccctgagaaatcacagggctgggttgccccttccttgtgatgtgtgacagaatgaacatgggaatgcaactgtctctttgaaatgttgatttagcggcgggatgcctggattatttggtagttcaacttctaattttttgaaggacctctatactgttgtgcataatggctataaggatatatgagaatatccattttaacatcatgggagttctacaatggaatattatttagccattgaaacgaagggaaatcctgccatgtgcaacaagatagatgaacctagaggacattaggtgaagtgaagtaagccacacacagaaaggcaaatactacatgagctcacttttacctggaatctaagaaagtgaaactcaaagaagcagagagtaggatggtggttgccgagggctgggggcggggtgaaaaaaaagggaggatcttggtcaaaggatacaaaccctcatcatcagattaagttatagataactaatgtacagcacagtgatgagagtttaattaatgtgttttagacttgaaatgcggtaagagagtagatctcaactgttctcacacacacacaagtctgtgagatgatggatatgttaattagcttggtagtagtaatcatttcatgatatacacatgtatcaaaaggtcacattgtatctgttaaatatatgcaatttttgtttttcagttttatctcaatacagttagggagaaaaagagagatgtggaatagaagaggaacacattttcctgcaggccggtattgtacaagtgttgaaacacttagattagatttcaggtggcaaatgaggtaccttcaggcagttcatggatatggtatcaaatcacgtagtagggaagttatttccttgtcaactatttctcagaccttgagactacatcaaagacataatttggtggttggttaaaaaaaaaagaaaaaaaacctaaaagactcaaacatttgatcatctacctttttgaccaagagacccagagcccctgacaggcaattctggcatctggctataaccgaatgacagtgttttacttttgcattagagttactttctacatatgacaaaaaaaatactgttctttctgctctttctgtttacttcaacgagctatttcttttctttaaaacaaatactcccatagactcgtaaaacatttattgagaacagaaacaatttaaagaaaagcacatggatgtgtaaaaattgtgagtatggatcgcacataactgaagtgtaggaaacactgttttctactggtgggtttgcattcaggggagagtttcttgtttgcattttgtaagtttcaaactctccttgtgtgcaggagggaaccagaagtgggcagggatggatacaggagtacagggtggaaggcagactggaggatgggtctgaactagagccatgtaggagatggggaggaggaaggtttgcattttcaagagactggataagtcctatccacatgacttactgacaatggatgggtgtcatgaatgtctccacccaggaacttgtcacagacggctcagcttaagtatttgtatatagtttgctgccgtgaggaagaagaaaggagttgatcaacactgacaatggattgatctcctggtttagggcttatatgccagtgaggttgcatatgagcatgacatagccagcaggatttgtttctattagtgccagtctcttgcccctgggagtaggagtggactagatctgtgcacttctgatagcagaacaaagacatgggagaaggttcactccttcctggaagggcctctttctagaatggggagtattcatgaaggagtttcccttcaaagaccaaagcgaagatacttaaggcacataagggcagaggctgctgtgagcgcccatctggatgagactcacagagtcccctggggattggatttcttttctgtttccaatgtcctttgtttaaggccgttaggcatatacattaaaatggaagaagctccaaaattcctggaatctttggaaatgaaaattagagcatccctgagaaagggtatttaagtttgagtctgaagggagatggggtggagagcatcctgggccaggtgcagaggagggagtctggaggttgagcatggcatgactaaggaactgaatacacgtcagtgtagctggggctcaggcagcagtgggaaaagtggctagagataaagctcaaagcaggcaaaggctaatccacctgaaaccttttgaccaggaagagtattatgtcctttaatatagaatgaaatctgtgtcacatggactgtgatatcaccatgagaaatggtcaggtgtgtaaagacagtttctttgtcttatagagtctacttgctcatagatcatgtttatgtatgacctttcagacttctgtcagttcccttctggtccagccatctctagccaaggaatgggacaaagagatctaacaccagcaaagctttttgctgtgtcgcttggcttttctgttcattctgcattttacatcctatgcaaattccctaaaactgtcaatcatcttcagattagtaaccctcattcctcttgggcatggctctcattccaaactaatgcatagccactagccagcctgttgtttagggcaacacctcacccctggtcctactatctctggtcaaagaaatgtgcgcggtcatctagcgtcagcaaatcatcttgtatctacagatctgcctcagctcctttgctcagtaagaacttgtggatgggatcttggtaggatgtgatacatataccacaagtagatctcattgtgtcctttttctctgctgagaagcagggctgtgcgagagacagctgcgcatgtagcccaccaccagtgagattcgacatcatttttactgagactggggaccaggcaatagcagagattatgaatccagtgtctgaaattgcgtgttcagaacccacagataggcagggatggaagtcagttctggagatactcagttggtggagatgggttgctgccaagaaatcctcagcagttttgttcactcctcctaatttatttcaaaaggcaaggtagtacagttttgcagtcaaacggatctggagttgaatcccggttctgccccttcaccagctggcagaccttggaaaagtcacattcctgtctgtccacagctgcatcgtctataaaacagggacagacatcgtttgtaaatcatgcatcccatgcactgttcttgtgtgccgcattagtcagggcattttcaattgtcatagaaaatgaagtcagactagcttaaggagaaaaataagtgacagttatgagtaaagtgggactgtcttcagcatagctggatgctggtactttaatttcaccagatgctaaggacggcaaccaccagctgtattaactcccacctgtggagaaaaggcgcttctttttcagtggcttagtaaagttcctggatgtggcttaagaggtgtcacttagctataaagggcgatgtccctcttgtttgtcttccctcagccaccccagcagtgggatggggtccagctaaatgacttaaatggactaaaaaatgagggagggggctgggcacggtggctcacgcctataatgccagccctttgggaggcccaggtgggtggattacctgaggtcaagagttggagaccagccaggacaacatggtgaaaccccatcgctgctaaaaataaaaaatataaaaaaatattagccaggcatagtgacaggcacctgtaatcgcagctacttgggaggctgaggtaggagaatcacttaaacctgggaggcggtgattgcagtgagctgagattgtgccatcacattccagtctgggtaacaagagtgaaactccatctccaaaaaaaaaaaaagaagaaggagggagtgtcacctaatgaaaccttgactgatattttttttccagaaaggaaaataaataataataataatagcaactaccttgcattgaggatttactacatgccatagaccattttttagtactttatgcatattctattattgaatccttagaaagatcctttaagacagatacaatatttatccccatgttacagatgagaaaaatgagggaaagaggtgatatggtttgaccacgtccccacccaaatctcatcttgaattggagctcccataattcccacatgttgtgagagggacctggtaggaggtaattgaatcatgggtatggtttcccccaccctgttctcatggtagtgaataagtctcccgagatctgatggttttataagaggaaacccctttcgcttgtttttcattctttctctgccaccatataaaacgtgccttttgcctcccatcatggttatgagacctgccagccacatggaactgtgagtctattaaacctttctttctttataaattatccagtctcaggtacatctgtatcagcagcgtgaaaacagactaatacaggaggagttgaagaatgtgactgaggccgggcacagtggctcatgcctataatcccagcactttgggaggcttaggcgggcggatcacctgaggtcaggagtttgaaaccagcctggccaacatgatgaaacccttgtctctaccacaagtacaaaatgtatccaggtgtggtggtgggcacctataatcctagccatgctattcgggaagctgagttaggagaatcacttgaacctggaaggcagaggttacagtcagctgagatcacaccactgcactccagcctgggtgacagagtaagactctgtctccaaaaaaaaaaaaaaaaaacaaatcatgtcactgaggtcacccaggtggtaactgtggaggtgggattcaaacccaggaagtctttgtttgactcttaacctctaggctgtactgcctcttccaagcatgcttcacaggaagaagaaaatacgtcccttctgtgctcctcatgctcagggcctgacacacaggtaaacggtgacttacgagagttattgcaacaaaaccctccacataacaggaaaaaccttggccactgctaaatgtcatcctgtgatatatctctgcattgaatttcctcccaattactcagcctaaggtattatctcggggtcctcaatgagtctgctccacagaaccatcaaaatgctcacggttccaagcagtgcctcacttgccagcacagctgacagttatttttgtaggcaagggcttctgactctaggatgggtctctgcacctgccttttatatttgattcacaggttaactcttttactaaacgttgaaaatgagatgttagtcgtactttcctctttcatttatttttgggaaatttgagggtggtggtgggttgggggagagggaggcaggtaaaaagacgcagagcttctaaaatgaatgtggtgttgagttaaattagcctctgatgggccggaaacctaaacgacagatgatgagaagctgctgggcaccctcagcagtgccatggacacagtggtaacccagagagtgtaatgaaaagcactgaggtagatcgggctattggtctcatacaccttcagtcacccttgaagctggctttgggaagctcatctaaagaatgccaggtgtaatcgtgtggctaagagcttcagcttaggattctaaaaggcctggctttgaaccccagcttagtggcttcctggttatttaacctctcagatgctcaagctcttatataaaagggagaggaggagagaatattttctggggtcactatgggactcaatgagctcttacactgagggtacttatcatcttggctaggcacaggatgcaccttgaataactgcaagctggctgggcacggtggctcatgcctggaatcctagcgctttttggacacaagtgggaggattacttgagctcgggagtttgagatgagcctaggcaacatataccctatttctgcaaaactgaagaaaaaaatatagccacatagttaggcatgatggtgcgtgcctgtagtcccagctactcaaatggcttaaggagaaggatctctggagcccaggagttcgaggctgcagtgacctatagtcgtaccaccacactccagcctgggtgacagagcaagaccctatctttaaaaaactaaagaaaaaaaaaataagtacaagctgcctgattattacacttaaatctgctttcgtcctactcttttttaaatctttgactctgtttcttagattcctagtgagatcagagagtatacatctaggacaagttaagataatagcaaagtaaattacaaagcttaaactggataccaaaccctcaattacctgtctagagttttgtgtatcctgtagctacttctcaatctgactgaaagagtatagagttgagagcataagtaaaggtgcagaccagggattggaaacagattgaatctctggtgtcaagtcatattgattgtggcggcacagaacaccttgttgatgaggagtctgagattgtggcatgtgggttctcccagaaagagtgcatgattgattagtgatgcctgccaagggtggaggagtgagagccacagggcacctgccaggtatagtttagttgtttctgtcacagaatctggcatctgaggagtaatacaaagccacgtgttgtgtgtttcagcccaaagatgcttctgttcttaggggcatgcctgttttccttatgttttggatttgcagcttaacaaggcactggtattttcatggatagtgcatggcttaaagataatttagcaaataagagctttatatcaggcatgggtagctagcctttcctaggtgctcgagaagccttctctgttgattacattatggtagcaattcacatgatgtcatcctcatataactagggttatgttttgatgccttaattttaaaagtgtgatttgtctatgatgatatttgtcatctctttgaaattttgtattaattggggctgaaatgcttacattttaatatcattatttatagctattattttcatgtgccacttattttacttaaaagaagcaagtctattttgtgtaatttttagcaaacttctttctttaaactctgaattaaaatgcatttaggaaatgcttaatcaagcacagagctatttttcaaagattgttctgtcatctcttctaaaaagatggcagtggcttttttgtgatgagtggagtgaacgttaattaatttttctttctcttcagttggtgggttttattatcccacttcttgatgtgtgattgggtgacttcacactttagatagaaagcatgccctatccaaatgtgatttatgttttcccagcacttttgcatggttcagctgaaattttcttcgtgttgatcaaggtcagaaaacccagggattatgccatccatctcagcaagtaggttgctggaaaaatttgtgatggaacgtgatgcaataacaacagaattcaagggtggggtgggaaaccatgcccgtgtgtgtgcgtttgtctatcacatgaacacactcacccaattcacttcttatattgtgcttctttttatcaagttacaaggctttttgggcaattctgggttaggatttatttttgcataaagccataaaaactgtgtgatctttttactgtggccatcttaaactaacagctatcagaatttgcagatcaaccagaggtttttcatattttctttgtttttttccagagtgattgcagtatgattgacaagtaaaaattatatgtttaagatatacagcttgacgttttgattttcatatacattatgaaaaagtcgttagaatcaagtgaattaacacatctatcacctcatatattgctattttttcttttgtttcttttcttttgcgtgtgtgtttgagtgtggtgagaacacttaagatctaccctcttagcaaattttgtatttccttttcaactgaaaggttttctgggtgctttggaggacagaaccttcagaatagaaaaggtcctaagcttaaggacttctagcttttggttaagggagcacagtagaaaagcaaatgctcaccatgagccaggcaggcagatctgatggagccagggaggtagacggcacttatcatcctaagtaaccgacccatggtatatggagaatccagtcaaaggagtaacttacaaacttcaagtccacctgtcaaaatagcaccctaacttacagtaaggaaaatctatctctgtctgtctatctatctatctgtctatctctatatattgagacagggccttgctctagtgtccacgttggagtgcagtggtatgatcatggctcactgcaacctcaccctcctgggcacaagtagttatatagtaccaagtgggcatgttgtacttactcagtgtgatcctcctacatcagcttcccaagtagctggaaccacaggagtgcaccgttatgcctggctatgtttttttttttaatttttgtagagacggggttttccctatgttgtccaggctggcttccaagtccggagctcaagcagtccttccatcttggtctcccaaaatgctgggattacaggggtgagccactgctcccagacaaacatatgtatttttaatttgatctattcagattgagttttcatgttgattgaattcaccaattcataagttgacaaatcttaattttgccccatgactggaatgttttcataaagaaatcataaaattagaagagctaaggatataacagaaaacatacccccaaagaaagcataagtagacttaaacacccggtaatacctttccttgatagtggtatgaaaatgcaaattaaaaccatataatataccaatctctatctactaaaattagccaggttaacatgaaataagaatactaccttttcccatattggtgatgttgctataaaactggtttccttatggccgggcacggtggttcacgcctgtaatcccagcactctgggaggccgagctgggtggatcacaaggtcaggagatcgagaccatcctagctaacacggtgaaaccctgtctctactaaaaatgcaaaaaaaaattagccgggcatggtggcgggagcctgtagtcccagctacttgggaggctgaggcaggagagaggcgtgaacccaggaggcggagcttgcagcgagccgagatcgtgccactgcactccagcctgggtgacagagcgagactccatctcaaaaaaacaaaaaactggtttccttatttacttggtatgttgcaatttggtagaaatcatttaaaaaccagagtactcatacgtatgaacaaccagataattatttcttttgacccaatcttactcattatttcttattattccagtcgaatggaaacaaaaggacacctggactgagccaccattgttattttacttgcaatgtcaaaatattggcaacaacctaaatgcttaatcttaaggtaatggcttcttatgctcagcacagaacatgatagagtattatgcggctattaaaaatgatgaatacacttgtgtcagaggtccatggaatagtaattgatataatgtttaataaaaacacatcttataagatattttgaccatgtctaaaatttgcatggaaaagagaaatattcatgttcatattcaaacatcattttattaatttgatatttgaacattagaaagtaagacataatagaagaatagggaagtctgttgggatgcatctaggaaggaatttaggactgagtttgggcaagttccttagtctttctgcatctcagattcctcttctgaacccaatttgtagttttctatccctcacctgctccccaccctttccgcctgagtccccaaagtccgttctatcattcttacgcctttgcatcctcatagcttagctcccacttaggagtgaggacatacgatgtttggttttccatttctgagttacttcaattagaataacagtttccagtcccatccaggttgctgtgaatgccattaattcattcctttttatgacggagtagtattccatcgaatcagcgtatcccagtaattataagagttcatgaaatttttgtgtgccattttacattcacactgccttttcacacgccaagttgcctttaaaaactgttgcgactactaagtagataggatgataatgcgaaataacaatatcgaacagctgattttaaatggcttggtcatatgttaacttatgcactgtaccaaatgtttctgacattatttggaataggtgaacccatccgatagttgttaatcacattcggtttcaaagaccgtaggtccatctcacctaattatactggtattggaggctaaggtaacattagctagaaatagatacttatcttttatttagtttctatttatgagcttttggaaatacaaaggtcattgaaatataatcatttcttataatccaccaccataacgcttagagtccattggagaaatatacatccaatataaatatacatccaatataaaataaccatacaaatattgtggtggggaagggtggcagggagggaggagagtgagagagagaagagggagaaagagagagagaaggagagagagaaaaggaaggacggatggatggaaggaaggaaaaagaaaagaaagagaaaagaaaggaaaggaaggaaagaaggaaagaaaaaagaaaaagggagggaggaagaaaggaaggaagatgggagaaaaaagaaaagaaagaacaggagaaagaaaagaaaagaaaagaaagagaagaaattctgtttatgtgacagaatcttaaacaagcatataagactactgacttcaggtacacatggatccaggtcctgaaatgattccataggaaacctccacccaccatgattccgcttctgcttttctgcttttcttgggtttggcttgccttgtgaagcagtgaggcagacatcagcagtgttagtcataccttctaccaattcacagttctggtagaaagatcgtttctcttcccaagtaatcctaacttaagcccatttcttaggtggacctatctctgatgttatgggtcacttgccccctttcccaagagacccattgactaaactgaatccccctagaccccaggcaagggcgtgtgggatgttgatcaacctggtctgaattgtaccccagtccctgaagtgctgatatgaagccagtgcaatgctaacaatatggaaccacaacaggggaaagacagctccctgaagaaaaaccacagtgcttcttaccagagttggaatagagattggtcacgtaaatgcaacacttgcttatagcagacagaggtgcaatttccaggtgatcagtgatgtctacacttcccaggctcatcattttatggtctccatgctccttccagagtagtcttcatcccatctgtgtcttctctatccactctctgatcccaaaggtccctcatatccctgtacgaagttgcaagtaccagtcattcaaaaatgtattgaggccaggcgtggtggctcatgcctgtaatcccagcactttgggaggcctaggtgggtggatcacctgaggtcaggagtttgagaccagcctggtcaacatggcaaaaccgcatctctactaaaaatacaaaaattagtcgggcctggtggtgcatgcctgtaatcccagctactggggaagttgaggtaggagaatcacctgaacccaggaggtggaggttgcagtgagtggaggttgtagtgagcctacattgcgccactgcactcaagcctgggagacagagcgagactccatgtcaaaaaaatatatagatatgtattgaacacaaagtaatgaaatatggggctgacttgccggggtggaggaccagcttcatgatgggttctgtgacccatgtgcctggcagagagaagaggctatggacaaaggcaaggacagaaatgtatcatctgtcatggagataagtcgcatattcctactcacaaaaaggcaggtgtacatttctggacagagaatgatagccaagacagtgctagagagaaaagtagttacagatattaagagaagaagcaaacacttgttggaggaagtgccatattgggaggatcctgaaagactggccaggtggaatggatctgcacacctccagaacaaaggaaggagactctaggaagggagaaacagtgagggaggaattacttcttttagagacatgttaagagaatcctattttaggattaccctaggaaataagtaggagattcagcactctcttggttctaatagaaacaccattcaaattggcttaagctaagattggtattaagtccttgttgtgggttgaatagagtcctccagaaaagatatgttgaagtcctagcttttcccacccccatacctgtgaatgtaaatttatttagagatagggtctttgcagatgttatcaagttaaaatgacgtcatcctggattggagcagtcgtaaaaccaatgactgggttctttatttttatttttttttcttttctttttttgagtcagagtctcactctgttgcccaggctggagtgcaatggtgcgatctcagctcacctcaacctccgcctcctgggttaaattgattctcctgccccagtctcctgagtagctgggattataggcacctgtcaccatgcccggctaatttttgtatttttagtagagacggggtttcgtcatgttgatcaggatggtgtcgaactcctgacctcaagtgatccacccacctcagcctcccaaagtgttggaattacaggcgtgagccaccgtgcccagcccgaatgggctcttataagatggagacctggagatgtacgaatgtagactcacggggaagaaaccatgtgttgatggaggcagagactggagagatgcacatacaagccaaggagcacgaggggtgctggccaccagcagaagctacaagaggcaaggaaggattctttcctagagtccccagagaaaacaagaccctattaggactttgatttcagacttctagcttccagaactgggagagaataaattactgttgtgttttttgtttgtttggtggttttttttgtttgtcttttgttttttgacacagtctcactgtgtcacccaggctggagtgcagtggcatgatcttggctcactgcaacctctgcctcccaggttcaagccattctcgtgcctcagcctcctcattagctgggactacaggtatgtgccaccacacccactaatttttgtatttttttgtagagatggggtttcaccatgttggccaggatggtctcgatctcttgacctcgtgatccgcccacctcggcctcccaaagtgctgggtttacaggcataagccactgcgcccggcccatttctgttgttttaagcaacccaggttgtggtgatttgttgcaccatccctagggaactaacatatttccatgtctgaaaatcgagggatatctggctttaggtatgcctaaatgtaggtgctcttgcaaatgtcatcagaagtgtatctgtcccaatttctcattttttttttcttggagttgactgcaattcaggtgggctcttcccaagcagagcaaactggcccagaagattatttcaagacttgcatttgacaaatttagtgacaaagccctgggcttggtcaggcttgcatcctgtgttcattgctgaaccaggccctgccacagtaggcatggtgtgttagtctgttttcacactgctgataaagatgtacctgagactgggtaatttgtaaagaaaaagagctttaatagactcacagttccatgtgactggggatgcctcacaatcatggcagaaggaaagcatgtgttacatggcggcaggcaagagagaatgagaaaacaagcgaaagggctttccctttatgaaaccatcagatcttgtgagatttactcactaccacaagaacagtatgggaaaaccactgctacgaatcaattatctcccaccaggcccctcccacaacaaatgggaataatgggagctacagttcacgatgagatttgggtgaggacccagtgaaaccatatcacatgggatgtggtatttgtccaggcctgagacccttgtgaatctctggaactttggacaagcgtcagctttacgtggacaccaagggcgatgggagaggagaggttctcaaaaggaaaagaggtcctcaaaaggtttaaaggaaaactgaagggaagtcaacataggggtttggggttgggggtgttattatcagaagtaggtagaaggatgctgcctaggggacacacacacacgcgcacacacacacacacacacacacacacacacacacacacttccctaggtcaactaggatcagataggtaggctggagaatagtagaggtgagtgttgtagttacggggagttcggaggaaggccttccatgatcagaaaggtgtgtggagaaagtggatagggaatagagtactatcctgccttccagtcaattttggggagtcatgagctgtttcgtttttacaatggcagcgcctgccccagttgggtcctagcccaaggtcaactctcaatagtaaataaaggtgccaggaaggcagtatagcaaccaagagaggaggcagaaaggtcctgaatggggagggccttgggaatgaaaactttgacttgatcattacacattctatgcatataatccacaaacatttacccctatcaatatgtaagctatttcgtattgataggaccagctcggaaaaaaggataccaggagcctttacagatgttattctcaacttactttctttttttttctttttgtttttcttttctttttttttttttttttttgagacaaagtctcactcttgtcccccaggctggagtgccatggtgcgatcaagggtcactgcaacctttgcctcccaggttgaagcatttctcctgcctcagcctccctagtagctgggattacaggcacccgccaccactcccagctaatttttgtatttttagtagagacggggtttcaccatgttggccatgctggttttgaacccttgacctcaggtgatctgcccacctcggcctcccaaagtgctgggattacaggcatgagccaccatgcccagccgttaactcaactttctatgcacagatccaaaagaccaaaagacttgaaaaagaataaaaggcacttttaagtactaaatgctttctacttgcaagactaactgctttacaagcatgattcatttaatctgcctatttaaaaaagtagatagatactttttttcagatgatgaaatagaattccaaaatattcaatgaaagtaccaagttcacataatgagtaagtggcaggactacaactagaatacaggttttccgtgctctagagaccatagataatttagctcctgttagaaggcacagaattaagggtggtcaacacatctgtcattccttaaggcccttttgtaacactgaactgatatatctccatagatacaaacacacatcaagatgtaaatatatgtgatatgtttctatggagactggaggcctattttattagtctaagatccatggacttattgcccctaaaaggctacctacatcaaaagatcctaaaaagaaagttttaaacatccagcctaaattaagaattccatatcaaaaacatcagggagctaggattaaataaaaattaagcccggaagcagagtaatgactcagcagttcattagagccttacattttcaatcaaagataaaatctcattaaaagtatatttttgattagggaacaagtttgggctgttccaaagttggacggctgtatccatagacatgtgagccatgaaatccttttttcctcttttgtaactttaaagatagtgagcgatttatcttctgacatcactatacaagttattaatatagaggaagactgaacaatggtggcagagctttttatgtatctaccagtgacttttaccccataaaattaaaaggcctattaatataggctcttccaattttaggagcaatttttgtttattactaaagtgattaatcagtaaggaaccataaagaacatctaacctagtaccgcctaatagaaatataatgtcaaacatatatgtaatgttacattttctagtagcaacattaaaaaagctgagaagaaacagctgaaattaattttcctcatataatctattcatcctatatagccaaagtattctcatcatctacttaaattaaaagttttgttttgttttgttgtgttgtgtttgagacggagtctcgctctgtcgcccaggctggagtgcagtggcacaatctcggttcactgcagcctctgcctccttgagttcaagcatttatccaacttcatcctctcaggtagctgggactgcaggcgtgtaccaccacacatggctaatttttgtgtttttagtagagatggggtttcatcatgttggccaggctggtttgaactcctgacctcaagtcatctacccaactcagcctcctaaagtgctgggattacaggcatgagccgctgcacctggccaaaagttatttatgatatataatatgtttaggtgtgtgtatctgtgtgcgtgtatgggtcctaaaccttcaaaatctagtgtgcattttacacttacaaaataaagagagtgaaaccaaagatttgagatttctctttagaggttttgtgataacacaagtgtttctattttgacagcggattgcatactagatttttcctttttgctttaccatatgtgggaaatgacacttctaagacacaagatacacagaacaaatgtagggaatcctttaagctctgtgtatctcagagtagatgctctgactgattaattggaagaagtgctaagataccactgacttgaagctttgaaagttaatcacttgccatgaatagctgataaggcttgtaacacggttcatccaggaggctgagtgaggctgggtagatgggtggtttatcgcattgtttccaagtgtagcatgaattccacccttcttacatgaagccatttggggtggcacatggatgtggcattcagtataattgaatcatacagtgagactctaatttctttctcaaatccatttcattctttcagatgtcaaagagatcgactctgcgtgttgctattatatctctaacacctctctaacccttgctaatctttttgaacagagagagagggcaagcaagctttcaacagacaaaatatgcagccagaatttcacaactgaggaacattgcagtgttccacccattcagtctgagtctccatctatttatggcatatcagactggttttcagttttgacgatgacatgaaatcgcgttttaaagtttactgacacgtaaaaaagtgagcttaaagaaaaataataagctaatcatggtaaaggtgactcaaggagaagataacaatgacgagcttgatatgtggatgttctgatgtttgggaaatgcttgtcttgctatattggtgatggaaaggggagacttctccatgcttgctgcagacatcattgcagtgcctcgtttcttggtctcactttcctttctttgacctgggaagtttccacaaatgatgcttcatggtcgcattctggatcacatcttacagagcaatggggaaacatgtacagtcatacccctctcttctaggaggtagcctcattatctttttatgctaagaacaaatagattggaaagggtctaacatttttttgagcatctcctttgctcaaaactttaaaacacctgtataaagcatagtctaaactaaccaccacaccatacaagagtacttgagtgagttctttgaggaggaaatggatgaggatgtggtatttgtgcatgtaacttcccttcctttctgttttcaagttcagtttgtccagtattaattcatcagagatgcagagaaaggctaaacaaacactgggaccttctacataaagccatagtttctacttgtttttttttttttttttttttttttttcatacttttctgagctttgcctaatggtctcatggagttctttaaagtagtgtttttatataatctgcctgacaggcaagacaggatggttgaaatttatactcccaaatatgacagagttcaacccagttctgctgtttcataacagtgtggtcttgaggaaatctgaagagattggcaacttggaacttcagttttctcatctgtaaaatggggtcatagaaggactaccacatagggttgtgtttgggaatgagaagagatagaatagcaatttcgtatggagctgcgcatatattcagtaagtggtcgaagtacaatttttactatgagtatgattcctgtctttgctttgcttttctctctctcttttttttttttttttttttatttgtcgcccaggctggagtgcagtggcgccatctcagctcactgcaagctccgcctcccgggttcacgccattctcctgcctcagcctcccgagtagctgggactacaggcacctgccaccacacctggctaatttttttgtatttttagtagagacgaggtttcaccatgttagccacgatggtctcgatctcctgacctcatgatccgcctgcctcggcctcccaaagtgctgggattacaggcgtaagccaccgcgtccggccctctttgctttttcttagacctcctagcagatgatttgacttgagttttattctaaaataacaataaagtttcaattttatactcttattttagttttccactatcaaagtttaccgcttagaggtaatatttaatgagactttaatcagacttctgcggttctgatttacatgtttgtgttttatctttgtaaggcggaaagatgctagatgggcacctaactttgcaaaccattttttaaataaatgttgcaatattaaaagcttcttggttaaaacatgaatgaagtacctttcactgtttcagctaccatggtgagcatagaattgaatcaatatttatacaaagattacaatataaatgcaaattgagctgcatgataattgggcctgagtaacttttaacatagttcgtagaaaacttcaaatttctgtactggtctcaaagtaagtagaaatctgtttaggctgggcatgatggctcacacccataatgccagtcctttgcaaggctgaggtgggtggatcatttgaggtcaggagttcgagaccatcctgggaaacatggtgagacccccatctctactaaaaatacaaaaattagccaggcatgatggcacgtgcctgtagtcccagttacttgggaggttgaggcaggagcatcacttaagcctggaaggcagaggcagaagttgcagtgagccaggatcacaccactgcactccagtttaggtgacagagcaagagcctgtctggaaaaaaaacaaaaaaatatattttgatcgcatcttggttaagtctttgctaccttggttaaaaagtttggtatcttggtagcaaatttttatcaattggtaatatttgcctggcaagctgtgtgaagaagagttcagaagtataaccagatttagcagaagtagttctgtgatcaattagtgatgttgtccttgtctccagaagaggtgtttttcatctccaaactttagtcagttgagaaaataaagtaacaatttgttgttaatttggcccgttagttaaagccgtaaacaaagaaataagcaataacatataatcacaattgcccccctccacaatggtcatttaaccagaaaaaaaaaaaaaaaatctttctccaatgagtaaaatgttcaaacttatctgacgatattgataataatataattaatagacataaccactctctgtaattcagttctcacgtctgtaatgtggagataatagctaccctttcttttcagccgggatactctaaagacaaagtgagctattttgagtgtcaatccagtaaatctttagtctcttctgctattctccaggaatatgcttgtgaaaagtcaagtatgtcccttaaagtaagttttgatattaatatctttcttttctgaacctttatttcttcttccaaatcttgaagttatctcagaaggatacacccttactcctgactgagaactctttgctcatatctactggatccagtttgttttgcccaatagaacaaaatgtcacgattcttttaaagttcttcctgggcaatagtgaagtgcctgtgccttgaatgtgtattgtttgcctgtaaatttcatcatttgtgcccaaggattagggcaattaaaacaacaacagcaacgaacaacgcaacagagtcagcgctttcagctcccactctcagataggaagcacacagccctgcctcctctggagggattgagctctcaggcgtcgatttcccagctgaccactagaggcgccccttgtgcttgtaccgcagttgctgccatcaggcttcgaagccgattgccccttcttggggaaattgtgaagactaaaaaaaaagtgtttcattttatggaaaaggaaagttagacatttgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaggaaatggaaggataagaaaaaaaactatgagagccaaaattcacaggccaggcaagtcacatcaggcctcataggggttgacaagctgcagtgttgagtgctttacacagctgggcaaggagtgaggacagcttctccatccatatgaccctgcttttaggagaggaatgcgtgtgatacaacatgtagaatactggagactcgagtttaaccacagggttatttatttaatgatgaaagagctaactagcagatgcgtattttccttgggcattacacagaggacttacattaaattgtcacataaaaaaataaaaagggtgagagaactgttctaaatttaaaaagacaaaaaggacatagttccagtgcagaggtcaaattttttcaagcctgttaatgacccttgagacctttaaatacggtcctgggcattagatttaattttgaatcaaagttaatattcttaggtgtgattcatggaattgtggttatgtaggagactgtctttattaggagatgcatgctaatgtatttggggaggatatatctatgtctttcaaatggtttaggagaaaaaaatacctgtaatatatacatgcatccaaaactatatataaacaaaactatatatatatgtatatagcttttgttttgttttcgttacaaatatatacgtttgcatacacgtgtatacatgtgtgtgtgtatgtatatatctgtgtttgtgtttgcatatccaaactgcatagaccaaatggctcataccaggtttaaggcgaaagcaagccctcagatctgcacaccctagtctaagtacagcagggtgtgtgagatggtgagacgcagttcaggtagtgcccatcagagatggagctttgcggtcagacatacctggattgcaatcctccttccaccagttaacaggaagttgactcttcatgggttttgtaactttgaagcctcagcaaagtggaaataacactttattttacacgaaatggttgtaagagtagagggagatcgcatatgtgaaaacatgtgtcacgcagtgggtgcctgctaatacctcttcccttcttttctccatgttaccccgacatgttacaaggtggggaagatagtgaatggtccacagtgtgaacagcaacctgtgggcatcctcaaatttgtttgcatctcatttgtgtgtacacggtatgttcaagcagagaaaatagcagaatttcctgatggttttcaatggtatcagcatgcttttatggttcgactttaggatctgatgttaaacgcaaggatgtacgcaaatgtttattagtttcttatgcatggaactggtgggttgctggtgttagaggctaatgtggccagaagatggcagtgcacgataaagaaaagctcccaggcgccagccactgttttaattagctaaaaggaagacaggtatgcttttatatagtttttgattttgtaattttcctgagcagccattgagggcagatgttttcatcttttcccccagtttaagtatcataggagagggaatatcaagatgcaatcaattgctggccacggcaaacctcctgaacttaagtcttgcaaacatcatcagcttgtgccatcttagaaattgctgcagtggaaacaggcatggagctatcaattacttctagggctgcaatcccctctgtccttgaaaaggaagccagctgattctgtgagtgagatgaggggacagccactggaatgggaggtggcttctttatcagtgtcttagaagttgatctggagccctagaggaagaaattaaagatcaccttaaattgtgcatgagggcctagccccctgtcgtgaatgaccgttaactggtcagcaaagtaattgaaacaggaaagtttggaggaaaagaaaaattccttaaagcatttcttttttctcttctagttgttacctttgtctttagagtgagtaatccttcatgcaaaaggagctagcatgttctctatacatacgaagtcctaggcatactttatacattttctggctttacttagggtgatcttcaattaatctctttggcaggttgtattagtaacattttacaaaatgggaaaatgggggctcaggaatagtgaggaacttgcctaaggctgcaggatgactgaaaatttacaggtgaaattcaaacctccatccctcatcatttccctatttcctgtccagaaaggaatgctaaataaatacgagctgtcaccttttatattccattccttttctttattcctgctgtacttactaaccaaaaataaagacaggaggtgttgttaatcattacactggcaataaatgacttcacgtaagtgtactaagagagggagagtttttcttttttttttttttttttttgagatggagtctcaccctgttgcccaggccggagtgcagtggctggatctcggctcactgcaacctccgcctcccaggttcaagcaattctcttgcctcagccacctgagtagctgagattacaggcatgtgccactatacccagctaatttttttttttttttttctatttttagtagagacaggattttgccgtgttcgccaggctgctgtcgaactcctcacctccggtgatccgcgttcctcactctcccaaagtgctgggattacaggcatgagccactgtgtctggccaagagtttcattttttggtcacacttaaaccaagtccagacatcatttgctagttacacaaaagtcatccatacttattgtagaacatttaaaaatataaaaaaggagaaaaacaagatggcctcatcactcaagaataccaattttaacaatttggtgtctgcccctatcctttttccctccaagcacctgaaattttaacaaacagccttcactcaatgttgttttcattatgtcatgaaagtgtttcctacaataataaatatttctgtcttaaagccaccattattaatgacttcatgtcctcttccatcatatggacattttctagtatttaaaaagcttttatttttgtacacttaggttgattccaacgtgacaaaaccaagcaggttctgtctagcttttgcaagacagaaaaaatactgcatattgacaaaaatgttatttgaaaatgtcccatatgtttggctgggcccagcgctgtgctcagcactgcattatttcatttcaaccgtgcagcagcagcagtggggactatcatttcttctacatattaagcagagagaatgtgaaggaacaaatcccttcgatgtaatcagacaggtttccacggttcagatgttcttatcactcaggtagaggtctcaaattagatgagacagtggtcagggccattcatagcaatcgaaggcgtctttcttcatgggaacttcacagatttgtgtgggcttagtctgagccctcgcccctcctcctttgctttattgatgcttcaggaagcctgtgggccattcagtttcatgtcgatgacagtacacctaagaactgctatgcgcaggcctccgttgtactcacaacgcagcttgtttttgcataatttaagcactacgtggttgtgtcgtttaagttctgtgaaattggtgttcttccatccatgaaattatatacatcttgggaacatttctcagttgctaaaggggtgaacacattcttcaataggggtgagacagcagtggagttgatagagcttcccccgaaagcacaggtatctctccttgtccttttgagacacaaaggtaagcattttcttctttaatgctaagggaacgcaattgtgagactaaccttcccattatgtttcaggccataactctttccttttctcccaacctcccccattacacacacccaacccagttaacacatcaagaaacccacagattgcacgtcctttttaaacattctctgcattgctgctactgtgttgtattttgagtgcttaagacaatgataatcttccaagaaatgcttttgattaatttgtgtacctgatttgtgtgtgtatatagattctgctcgtaatgatatgatgtgaaaatactcattatatataacaaaccaataatatgtcgtcatggaaaagcatggttaaactcatttcagaaatctttgcagtgttaaaaacaggaacagcaggtatctagttcctgaaagaatcacacttacagatgaagggcttttgttgttattgttattacttggggcatccatagaaatacagattatgagtatcctttgaattcttggttttaacatcaggtagtaaataccgtatgttctgacttagaagtaggagctaagctatgactctgcagaggcacacagagtgatataatcgactttggatactcagaagggggaggttgggaggagaatgtgggggtaataaactgcatattaggtacaatgtacactacttgcgtgacaggtttaccaatatttcagaattcaccactatataattcacccatgtaaccaaaaaccacttgtattacccaaaggctactgaaattaaaaatatgtaaagttaagttaaataattaaacttaaaagtggtgatctctgctagtcaggataagctagtctgtgcttcagtaacaaacatgtcctgatatcttggtgttttatcacttgcaagcttatttcttgccacataaaattaacttcaggtctaatagttctataagaaggttctcttccaaggggaagtgccaggattcaggctgctcctgtttcatctagctgtatttatgtcctgtatggtttttcaaagttgcagcggccggggaggacagaggatggaaggctcacagctactctgttataggtcagcccagagtggtcacatgacactcctcttactccctattggctagaacaagtcacatgggcccaacctaactccaaaggagtctgggaaatgtgtgctcaggaagcacaaaatgaatgatgacacagtgaatgcatgttatttctctccaccgtattttcaaaacaatcatcttgagtgagagcttcagaaatgaaagatgacacatgctaacaaaaccactcttggaaacatcttctatgccaagcactgtgctatgcacctcacctgttgtattagtccattcttgcactgccatagacaaatatttgagactgggtaatttacaaagaaaagagatttcattggctccgggttcagcaggctgtacaggaagcaccacggcttctggggaggtttcagaagactttcagtcatggtggaaaaaaaaaaagagaagcaggcgtgtcttaggtggctagagcaggaggaagagagagatggcaggaggtgctacacaattgtaaacaaccacatctcatgagaactcagtatcatgagacagcactagggagatggtgctaaaccattagaaaccacccccatgattcaatcacctctcatcaggccccaccttcaacagtgaggattacaattgggcatgtgatttgagcagggacacagatgcaaaccgtattacctgcattcttttatttagaccccttggcaacagcagtggggattttcattttctccatataagaagtgaggagagagaggttgagcaaagtaacttcccaagcaccgtagtggggacaataggagtcaaactgaagactaccagaggtgaagcctgtatcactgtccaaccagccatttgacctgcagattggtattctttattttattattattatactttaagttctgggatacatgtgcagcatgtgcaggtttgttacataggtatacacatgccatggtggtttgctgcacacatcaacccatcatctacattaggtatttctcctaatgccatccttccctagcccaccacctcccgacaggccctggtgtgtgatgttctcctccctgtgtccatgtgttctcattgttcaactcccacttatgagggagaacatgcagtacttggttttctgttcctgtgtcagtttcctgagaatgatggtttccagcttcgtccatgtccctgcgaaggatatgaactcatccttttttatggctgcatagtattccatggtttatatgtgctgcattttctttatccagtctattattgatgggcatttgggttggttgcaagtctttgctattatgaacagtgctgcaataaacatacatgtgcatatgtctttatagcagaatgatttataatcctatgggtatatacccagtaatgggattgctgggtcaaatgttatttcttgttagagagcttatcctctaaggctgattatgtctggagtttttgtaggaagtggttgcaggatcctgaggttgaattgtttcttgttttcatatgtgtttataattcacatgaagtgatagaatagactttgaaatataaggaaggtatttctcttaagtcttcacctccacatatattatatatgaaaatctagatttatttgatgtgggcaatagataatacttttttcctaaaaatattatttttatatggtaatttcttctcatgtgttttaaatactcatcttctaaggctgagtaagtgtatttaatgcacaaattttttttatgtttatgcaagagatgtttacacaggacttatctttcctgtaaggtgcctcagcctgtctatgacaatgtctactataaacaatatcaaagggtttctgtattttatatcttcctgaatgtagacatattccttggggacagttgtcatgaaaatcctctggaagtactttggtgacatgtccgtcattcatgttctgtttggttcttccctgaaactcccacaacatggaaataaacagagagcccagctgttttgtttctccgtcttcctacggggagagactcaatgcacagacttcttgagcgagggcagtaagctttgtctcctgcaaagacatttgtctctgaatgtggtttccttttgtttcatgcttgtgagtgtgtgcttgtgtttgtcaattgagaatcagcaacgaagaggtgtaagagttgactgttccccagagtataagggcaagctgatagaaaatcagctttgggtattgatgataaacaagttaatcttctttgggtaatcttttgaaaagaatccttgctttatttatttatttttgctttttttcctgttgggaattatccgtgagtgaaataaaaatgcttagaagatggtcttagatttcagcctctagcttataaggattgaataaatgttttattactcatgagttaaaacataggctaattcaaaaagagtttactttaaagagcatgactctctaagaagatatttgattttatcttattggaatactaggatgtggagaaacaatgataatatgtgtgtttttaagtgtgcttagagtgataacatcacctatgcaatatacgtttctagaaaagataattcacagatccattcgtgacaaaaattcatataaagggccatcacacttttaaaaaaatggagggactatttgaaatgcaaaatgattttgcctactatagtttaacattaaagaaaaaaataaaattaacctatttgtttaaaaaaatagtatataagtaaaaggcaaacaaaacctcaaagatcatcgtttcaaaactatactgagatgcaggatgatcttatgtatcattatttagtaagaccaagcagggattggttgattcgttggctgcttaggaatcataaacctctgcttttagtcgattatagtacagtaggaagtgggttgaatcaaaaacaatatttctaactccaggatatttcaagttcggtttggtttcttttctttctttctttttttttttttttaactttagaagtaccatgagccaagaaaggtagtgtccccaggccatcattttccttcctctaaattcacattactgaatttttccccccttggactctgaaacataatcaggggaattggcaggtttgggttttcattttcacctccggctaaatctgtcaacctgtgatgaggttggctgggcatcatcaggaagcgaactgttttcctatttgtagagtggaaacaagtaccagcgcttgcagcttccagtcattttgttattcatgttacatcatgttccttctgattgttaacatgacgatgtcactgtgtcttgagagatgttgggaaaagtaaaagggaattacagagtcctggaaagaaatctcccaaccatgtcttttgtatcaaaaagtgtctgctattagctgtgggggagctagatgtcactcccatcagaggatggttttctgtccctataaaattattcccgtgtctatacagagcatctcgatgtgtgcgtgctgcagaggtagggggtggcagagctttaagcccgtaataaacataactgtttcttaagaaagcttattttgccatcattcttcactcttctctgtccatttccaccttcccaatccaaacttgtcactttcaacacctattaattctccttcctcagtacctttaccatctattcctttttctttattttttttgtggatgccactcaagtttgggaagtaaaatcattctgagtaaatgcgtttcgcaggtttcccgttatcacattacacgcgttatatgtatcatttgatatcatctttacatcaatcccaggaagaaagaatgtgtgcctccactgtttaagatgaccttggcttacaaacgtaaaatgaccatggcaggtaggataatggtcctccaaactgtccacgtcctaatccccaggaaccatggatatgtcaccgcacatggccaaggaattttgcagatatgattaagttgaggaccttggattgaggaaaattaattatccagataggctcgatgtcatcccaagggtccttgaaagctgagcacttttccttgctctggtcagaggagagaagtgacagtggaagaatggtcagaaagatgctacttttctggttttgaatatggaggaaggggccatgggccatggactgttggtggccttttgaagctggaaaagttagggacatggatttttcccctacagctttcagaggaaacacagccctgcctgttgacaccatcatttcagtccagtaaaagacaagtcagacttttaatatacagaactgcaagataataaacgagtagttattttaagtaagtttaattaagtaagttagtggtaacatattctcctattttacagatgacaaaaccaaggtaactataaagattactttgttacaagtttagcatcaataggaaactaactcagtgacctccctgtaagatcacccagggagtaaacgtgtgtctgagctgtggtttggattcatacctctctaacattaaagagcagatgtcgttttcactaagtgtttcatcttctttatttcttacctagatccttgaagtcatttgatacctggtatctctccctagagttcctctcatttaaatccatcctactcatcactggtacattattcttcctagaacattgaaatgtttaactactttccgtgaccctgtggcctaacaaagaaacaaacagcatgtgtcggcctcctggttcctctctgaattacttccacttaagttgttgattcacctacactctagcaaagctggaaaatttttgttgtcctccttccaccatgcacttttccatccaaacacatttttttttttttactgtttcttccacctgaatgtgtttccctttaaccaacacctagttgaaatgcctactatatactccaagtcagagtaatgtctttatcttctgatctgtttcaacccacctctggtatcaacatcatcatcatgatcattgtcactatcagtactatcactaccatcatcatcaacattatcttcatccactaccatcaccaccatcatcatcaccatcctcatccattactatcaccaccatcattatcagcatcatcttcatagtactaccatcaccaccattattatcaacatcatccccatccactaccatcaccggcatcattatcaccatcgttctcctccactaccatcacaaccatcatcatcaacatcatccccatccactaccatcaccaccatcattatcaccatcatcctcctctactaccatcacaaccatcatcatcatcctcatcctcccccaccatcaccatcatcatcaccatcatcctcctccactagcatcaccaccatcatcatcaccatcatccgcatccgctaccatcaccaccatcatcatcaccgtcatcctcctccactaccatcaccaccatcatcatcatcctcatccactaacatcaccaccgtcattagcaacatcatcttcctccactaccaacaccaccatcatcaccatcatccgtctccactagcatcaccgccatcatcatcaacatcatcctactccactagaatcaccatccccatccactaccatcaccactatcattatcaacatcctccttcactaccatcaccaccatcatcatcaccatcatcctcctccactaccatcaccaccatcatcatcatcctcatccactaacatcaccaccatcattagcaacatcatcttcctccactgccatcaccaccatcatcatcgtcatcatcctccactaccatcaccaccatcatcatcaacacatttttattcactaccatcaccaccacaatcatcatcatcatcctcatctgctaccatcaccaccatcatcatcaccatcatcctcctccactaccatcaccaccatcatcctcatcctcatccactaacatcaccaccatcattagcaacatcatcttcctccgctgccatcaccaccaccatcatcatcatcattctccactaccatcaccaccatcatccttattcagcaattctttagtgttcacagagtgccatatacaatgttggatcctttatgagaatcatctaattgactgtttacccatatgaagtagacactattatttctcctattttacagatgacaaaaccaaggtaactataaagattactttgttacaagtttagttttctattgtaatataggcatgtgtttgtcatatgtcactactcagatgctgaaatgtttgaaacaaatttcaataattcaacacccaggtttggagaagagtttcatcttttgtttaacctcatcatgactctgccaactgttggagttttccttgttcctgctaaataatccctttagggcaacttctattgcatattgtcagtattccacccattgtgcgattctccaattttgttaaattagagaggaggttggtgtgtgagtcaatttttctgtcttatttatcttgacaaacaatttaagagattatctggcatttggagttggcggagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaagatggccaccaggagccaccagctctatcatatcctcccagcaactccattggtaataggtataaaaatgaattccagcattgcctctcatttaactaattcagggcaagggcttttccgtgcatcagtcactgtgacggaacacagtgattggacagacctggtctagagtccagccccggagccctgggaaccacacggcaacacacagaagacagcatgcgtggtaaacaggactaacacttgtcagatctcgggggaaaggatgttgcatagttcagtaccacaggtgtcactgtaggtgaagggaaaaaaatgacacatagacattctaaaagctgcatttcatattaaatcagccaggctttgatgcatatggagaagaacttttagatgaatgctatttcagaaagcccttgtcccagtgaatattactgtgtgtaaaaaggaaaaaaaacaatggccgggcgcagtagctcatgcctgaaatcccagcactttgggaggccaaggcggttgggtcgcctgatgtcaggagtttgagaccagcttggccaacagggtgaaactccgtctctactgaaaataaaaaattagctgggcgtggtggtgagtgcctgtaataggtactcaggaggctgaggcaggagaatcgcttgaacccaacaggtagaggttgcaattacctgagattgcgccgcttcactccagcctgagagtaagagagaaactctgtcaaaaaaaaaaaaaaaaaaaaaaaaggaaaggaagggaaaggaaaggaaaagaaaatgacataattaaatgtatctggtcactgttggattaaacaagtttctttaagatttcttggagcccttaagtggccgacgcgcctattatgaatgtttcaagtatgagatatagaatgatgagcactctcaatatattttcacttggaatcttctttagggagaatatattgtaaaagacgatcatagtgtccggcctattgttagtactccatagatatttgtcaagaaagtgaatgactgtcacttattttggaaaatatagttcaagaatcatgaatcctctctgtacttcttgtagcaaaagtaaataacagttctttgatatcttcattgtcatgtcctgttttgtttgttggttttgttttccctgctggaaatccaggtggctcaggatgaacatctccatatggccgtgaatctatgggaggaaattgcatatggtgaaaatagtggacaactgactgttccttttataaccacattgcaataagcttttaaagagatgtacagacatacacacactgatctgatttctacagcgtatccacttaaactggcaaagacgtttaccttgcttgaggcaattgttgtatctagaaaactgtgaaaattgaattaaattacaggtagaatacactggggagctcattactaaatggatcctatactgcgtgtttttgtagaatgaggaattatttcataaaaggaataatactctctagttgatataataaatatgcttaaattgaggtatacaatatctgtttgtaccactattacaggcacataattgtcatttatttaaacttatctccaaactaagtgaaatatctctgactttttcttagaagttttctttggaaaaaaaaatttagactagcactttctttataatatgcagtgagtcttgttttatattgaaacctcaattcattttcttcctagtgaaaaatgctttttcatcccctctgaaataaatataatctttgaaattggagtcgatgtaaatccagaggtaatgagattcagtttttcattgtagccgaattagatggagaacttcaaatatttatttgaggtttaattcgagtaatttaggaaaacattgagctttctcattcataaatgataattacgtctcttcatcaaatattatactatattcccttctgctatctgtacagtctccttcagatatgaacagttttatatctcaaaggagattttttttttccatgtaacttccttggcttgtttaacttacaaaacctttcgaaatgcagtttgctgtgcctgtgtttggagtgtttagttttgtagaaaaaaagaggtgagaagtagaataacatttacattgattttcttcaaggttgtgctctactgagaaatagtattttgtcttactaaagcacatgtttaagaaatggagattgctgtcttgcaaaacccccaatataaactccagcaggctaaaatgcctgtagcctctagttgattataattctgtaccaaatcaaaagtgactgcatttaaaaacttccataaagaaaagcttagacatttcaaactaatgcttggccaatgcaaaattatttattccttccccttcagaatttcttctggggaaagccaaagaaaaatcatatgaattgcttgaagatattcagggattgactagagaaatagggcctctaccttggtggtgatgatgttatatattataatatgtatatatggtatagtggtcactgtagtggtagctgcagtagtggaccaggtttttaaattttctgcatcttaagtccttttccacccactgtagtcatggtacttgactttggtcactaagcttgccagaggaagtcatattaagtattccaccagccagggatcctttgggtgcaagcaacagaaacccaattcaaactaccttcaacataaaagggaaatatactggctcataggaaacagcccacggtgagactgacttcaggaattaaggaatccaaaaactaaatgatgtacagaatctaatatctccttataaatctgctttccattgtgtgatcacatggtccattctcactggagcagcttgagtcaaaggcttatcctggaactggtttctgtgttggtggatggaatgatgatgtgggagcaccaagccaaggttatttgctcacctctggattaaaaggggaagaaaaccccatggcgaacaaatgaagtttgggatgatccttccccaaagaaacaggctgttgtccaaaaaaggaaggaaaacagatactgagcaaaccagatcaacagaagacccaaccttggtattggaagtccatatctctacatggcccacctttagccttctccagggacaccagatctgcccagacagtagaagaacaattgtaatcaagggtaggatgtggccagaagaccaaaagtctctttttttaaaacatctgttctattaaggaaccaaccagagagttgattggtctatggtatgtacttatgtcttaactgatcaaacttattatcctcctcagtaattaaactaactagaattgtctcttgtcccactgcacactgtctgtgaatttggagttatttcaactgtttggaaatcataaaatatgcattttgttactcatgaattaagagctagaaaccagaaatccacttatatttcttccacctcccttaaaattttactttccctcgtgctccaatttgacaattagatcatgtaaatatcattatgtaaaataatacagcattaagatgtccacagaagatatggggggtaatctatttgtacatctaaaccagtccatttttctaagatatatgaggatgtgggaaagtctgcattgatcttcaagtgcaaatttttaagagaacacaatggatggtttagctacaaaaactagagattcttaagtaagaccattcttgtgaagttctcctgtggccgccataacgcaaatcaatcctgtcattatctcttcctgggctgggccctgtctttccccatgagcgcttaactctttcttttgtctcttcaaatttttgtttgctcttctgaagtcatcatcgtcaattagtatttgccagagccccacagggtctaacatgccacttctccatctgttattcaccgaggcagacgtggtgggaccaccccttttaggttagaatcacattattctatgctattttcagcatctcccacctgctgtcctccaagccgttctcaaatcccacatctttgttctgccctgttttcctcccccacggtttgactttctaagcattatgcaatggtgagaaatgtgaatcccttatagtgatatggaattccatgtcccccaccttctagttaatatgaccttggagggtttttggattctttgtgatattttcccccttattcataaaagaggcatattgaatgtgtccatagcgtacgaagactctagaacaaggggtgatgattgtgaaaatgagcttaaagctagagaatgtggcgttgttcttggtacacattaggtactaaaaatgggtgtttctgttattaccttagggattcaagtaggcaggcaagtgacaatcataaccagcatgcagccatcatcagtataagaaacagcgtcttcaacccatttgaagtgccacccaggcacccctgtcatgtcagtttttaaaccatttttatcagtatgcaaggcagcatatggactactgttctgggaccaccttagccttgaactctcttcacgttcactgttgtgaggctttgccttcatagttatcctccctatgttacttttttttttttttttaaagtgactttcaggatcagtgactaaaataaggttctctgtaacagtcataataagcaggtattttttatgcaaaagtggtgtctttcagagtccagaccatgctgcgtgtctttgaaggagaagcctgcatttaaaagccaagccattttgacaatattaattcagttaatttcagcacattatataatgtgtccagtgacctatcaacgctgactggttgggcactccagtaacaaacaccaaagcgagtgatatgtcataacagacaaatgggctctttaaactgtacgacgggaagagtgtttttgttggcatgaatactcatctgtcaaccagcccctgccctgttctgatgatggacaaggcattgggttaacacagaaggacataaaatgaatgatcaggcatggccgttgccttgaaggagtttatgatcaaggtgggataatgaggcataaggacatgaacacatgcaggcacggtgaagaaaaactcatgatggttgtatgtagataagtgtcaaatgaggggtctgggcactaaggatagctattctgccacaagtccttcaatttgggcccaaaggtaatgttaaatttgtggacaggtacacattgttttgagttattgcatcaaaacataatttgccctggtatgtggatgagctagctgacatacatgttttcagggtatcttttccttctcttacgattggcaagaaaaagcttaaaacctctctctcatcaaatactctcccccactcaccgtagcatccctgaataaaccaggtgggtacctggaaattgtagaggcattcccctaaggtgatgtatttgatcatcagagccagagtcgggggacttactcaatttttcacccagagaggaacgtgagaagtgtaccatgcactgtcctttcctgatctcagggcttcctctcaatagctgaacccaaggcttgttgaaatgaaatgaaaaataacagtataacatgcttacataaatttttaaaacatcagcaccataggcaaggttaaaacaaaaaaaaaaagaattttgaccaggtgtcatgtctcacatctgtaatctcagcactttgggaggccgaagcaggcggatcacctgaggtcaggagttggagaccagcctagccaacatggtgaaaccctgtctctactaaaatacaaaaaatcagctgggtgaggtggtgggtgcctgtaatctcagctattcaggaggctgaggcaagagaattgcttgaacccgggaggcagaggttgcagtgagctgagatcgcaccactgcactccagcctgggcaacaaaaacgaaacttcatctcaaaaaataataataataataattttttaaaaattaccataagtagattcgtgaaaccgagtcacctggtaagacagactttcttgaaactcaaaatttcattactacatttaccatgttatctatggcatatcccagcaagtaattaaaagtagtggttcatgacatatagaatttatctagtaatgaaaacttgcactaggagtgtttttaatgctccaaatatcctctttacccaatttgctagtcacgtcctcggactacttaaccattgttcgaggttgggttcacagataatcagaaggcattgggggtaccagatgcttatgagggatccataccagtaaaagaaaggagtagagagcagagttgggcagaggggggggtgagtcagactatgatgtgagcctggaaagcctcagctgacccattggggagctccagaggtgaagagtttatcagtgtctctgtgtgtgtatgtgtgtgtgtgtgtgtgtgtgtttgtcttgggctgaaatggctgggactttacctcctacctctctcagtcattggatgcaagttgccccaggaagggtgtgatccttgagcaaggaggctctctgcagctgacgcaggccctgaaggggctgacagctgtggctgcctgctgacgtcaccccctgcagctgggtacgggtatttgtgagatgcatctccctgtttaccatcatcttactgactccacaaagtgggaagacatctgcattagtctgttttacattgctgtaaaggaatacctgagattgcataatttttaaagaagaaaggtttatttgactcttagttatgtaggttgtacaagcatggcaccagcatttgctcagcttctggtgaggcctcaggaagcttctatttctggtggaaggtgaagggggagcaggagtgtcacatggtgagagaggaggaggtgccaggctctttataaaaatcacataaaggcgtacgtacacctgtgttcattacccagcactattcataatagcaaagacatggaatcaacctgaatgcccatcagcagtagactggattttaaaaatgtggcacatgtacaccatggaatattatgcagccagaaaaagaatgaaatcgtgtcctttgcagcaacatggatggaactggagtccagtattctaagcaaactaacataggaacagaaaagcaaatactgtgttctcacttataaatgcgatctaaacactgagtacacacggacacaaagggacaacagacaccggggcctgcttgaggatggagggtgggaggagggtgaggctcaaaaactacctgttgggtactatgcttattacctgggtgacaaaataatctgtacaccatacccttgcaacatacaatttacctgtataacaaacctgcacatgtacccctgaatctaaaataaaagtttaaaaaattagacctcgtggtaaatcactcattacagcagggacggaaccaagccgttcataagggatctgctctaccatgatccagacacctcccagtagacccacctccaacactggagatcacatttcaacatgagatatggatgggacaaatatccaaattatcggccagccgtggtggctcatgcctgtaaacccagtactttggaaggccgaggcaggcagattacctgaggtaaggagttcaagaccagactggccaacatggtgaaactccatctctactaaaaatacaaaaatctgcctggcgtgctggcatatgcctgtaatcccagctacttgggaggctgaggcaggagaattgcttgagcccgggaggcagaggctacagtgagccaagattgtgccattgcactccagtctgggtgacagagcgagagtccatctcaaaaaaaaaaaacaaaaatccaaattatatcaacattctattccttcccaaaaagttctgctgaagactaaatgaggtcatacttctaagatacccagcccagtgactggtgagaataattgctcaataaaatcctgtacggcagatactgttctctctctggtttttgttttagtctttagattttttaaattatttttttgttatggtaaaatagacataacataaaatgtaccaccttagccattttaaatgtagagttcagtggcattaaatacattcacattgttgtgcgaccatcaccaccatctgtctccagaactttatcttccaaatggaaactttgtacctatgagacattaactccccattctcatgtcctcccagcctctggccaccagcattctgctttctgtccctatggattcgatgttctaggtacgttatctaagtggaatcatatggcccttgtcctttggtatctggcctatctcacttgcctcaaggtttatgttgtagtgtgttattcttatttccttcgtttttaaggctgaataatatttcattgtgagaatatatcatgttttgttttgttatatcatgttttgttcatttctctgttgatagacatttgggttgtttccacctgttggctactgtaaataatgcttctattaattacttattattatttattattattacagagctgttaatttcatttcatagataagaaagtggctgggagtggtagcttacacctgtgatccagcacttagggaggctgaggcaggaggtttgcttgagcccaggggtttgaggccagcctaggcaacatagtgagaccccatctctacagaaaatataaaaaatattagccaggtatcgtggtacatgcctgtagtcctagatgctggggaggctgagatgggaggattgcttgagctcagcagttcaaggcagcctaggcaacatactgtgaccctgcctctaaaataaaaataaaaaaagcctggtgtggtgttgcacacctgtagttctgacttgggaggctgaggtgggaggatcacttgagcctgagaagttgaggctgcagtgagccatagctgagccactgcactccagcctggatgacacagttagacccagtttcaaaagaaaaaaaagaaaagaaaaaagaaagtggctctgagagttcaaggacaagaccagcaactgaatccacatctgtccaacccagattccaagctgctgactgccatctgggtggcttcccctctctgacaaggatagccagcaactctgaaaagcaacttactctgttacacctgaggctacagcagactcctcctatctcatagaaaagaggcctcagcttcccagcctccagcaaagggaattttctaggtcccagtccccctgctttgattttaaccctctctgtgtctctctcctctgacttctacttccttgctctccatctaattccccctcctcctcgagctctttgaagttgagggagtctatactgccaggcactatccttgctcttctaatttcttaattcatttcaccttcctcctagccccatggggcaggcattgttattatcatccccatgttgtgtgtaaggaaatgggtcatgcaggagttaaaaacctgcctaactttcacgcagctagtaagtggcagaactgcaaattgaacagccagtccctgctccacagagatatgcaatgctacctcttgagctaaaacagaaattcagaccccactttgtagacacaatggctcagatttaggagacgaccctgcagccaaacctagacaaacatgaggtggttctgctgtcctgagcttgctgctcaccgtctctgcccacatggctctagctgggctcaggactttcctcttcacagcaggctgaacagcaaacccagaggccattgcagctgcctcggtattctacaccccccttgggtctggaagttgttggaggcaggcataccagactgtttataatatggatgctttctccttcacctagctggagccaagaggggtgggggaagactgagagagacagagacagggagagagagagagcctgcctaactgcctatttatcccaaatccatatattattttggaacattcagtattgcagaaatacatggagggataaatcatttcttctgccatctggtctcggagaaccttcccaagaactgtagcttcgtttaattttgctgcgttcctttcccaccctctttgtgctttccatcatcttttcttggctgtatttttgggtttgttttgcttcagtttcttgctcttttagctgtttctggatttcaatttttaaaaagaaataacggatcgcacttatccaagtcgtgccagattctttatttgggataatgctacctcatggctattttttaactttaatccggaaccttggagtgacgtgtggatttttttttaatgccccaaccagatgcactaagcagcttgatggtcagtaatgaggcagcaccaggaccctgtggtcctagagtttcttggcagtgccttcatggcaaatgtttcagtgagatgagcgtggcagacccagcccagccattgctctatggttccaaagtccttttaaatgaacaaatgggttggcattcatctagtgggactgcaactccagtgaggttactcaaaacatactgggcaaaggtttctcactgtttgagtgggaggttacaagggaagaagtctagagcgatccatggcatgatggatgggggttggcatcagaatgaatcatgtttagcttaattgggacacagatggttaagtatagaaatacctacagacatacatacatccctgggttactgtacacatagatcttcttgttccgtcagtttagaggtcctggaagccacaaccccccagcagcaatgagcatgcctactacccagatctcagtttctaataccattctccaaaaagggaagaagggctccttggagaagcggctgcttttaggactcagctatgaaatatacaagatgagcctgatagcaaatattttacagtgcaagaaagcgctcacaacaacaacaaagccactgtgatagagtatgtcttataaatgagaaataaagagggataaaattataaattagggcctggcatggtggcttaagcctgtaatcccagcaatttgggagcccgaggcaggcagatcacttgagctcaggagtccaagaccatcctggctaacatggcaaaaccctgtctttactaaaaatacaaacattagctgggcatggtggtgcatgtctctagtcccaactactcaggaggctggtgtgggaggagcacttgagcctgggaggtggaggctacagtgagttaagatggtgccactgaactccagcctgggtgaaagagcaagactctgtcttaaaatatatacatatatagatagatataggttagatggacagaattgtggaccacctttcacgcctattaaaacccggatgcttagccccagtggctggctttgtacaggcattgtaatctttgttgtgtcagggtttgtgttgaaaactttttactgctcccgtgaataggtaagccctaaattcctctccttaggttcacaacagcagtggctttcctggtcgcccatgtcccagttttgatgatagggcaacttgaaactaaaagagtgaaaaataaatcacatttacgaggagaaaatggagtcattgcaactcaattattaatgtgcaaaactgttatgcaatgtagcagcccaattaataggtgtctcttggggaataatcaaggcttaatttggcatgataattagtagcctccccttccagctttggatggggggcccctgtaggacagcctgatggctggtaatgaggcaggatcacttactttgcagccgtgttaattgtatctttctgtgcatggggacaaaacagatttacctgtttctggatgctgggatgtgccattgctctaatagagttgtacttgtttcctggtcttgccaacactggcctttctgaagggcaacactgttacacttttgagacgtctttaattggctgagttgttctaatggctacagctgcagtcttttttttttttttttaatagagtgtgtggcagagttccaatcttacaagacatacggccagagctgacatattcttaggaataacagaaaattgtcctgtttagggtatctgtaataataggtgaccagaagtcatctggtgtaggtatctatctcctctatgtgtctcagagaactcctgttttttgcaatattgctagttgtttgtacaagctgtatagtcacttaaaagaaaaccatgaaaaattacaaacgtgtggtatttttactgacaaatgtggaacagcacagagaagaaaatagtatatcatctctaatgatccatcagccgagggataaccactgtcatcattttggtataatctctttccagacttccatgcacacacacatttctccccatatatatttaatccagatgtgatttctatttgcaaaaaggaaattgtaaggtgcatactattttgttaacatgtcgtttgatcataggaacagattttgaaccagatcaataccagcatttcctaaacggtcctcctccaatatttgggagctgctgatctgtgttctgaaagtgaggctgagacagacgcatttcctctcctcctctaggtaacacacaatgaacattcatatttcaaagtctttgtttacatgttaaaaacatcattttagggaaatcatacgttaacagctcctacaattgtcttccttaaactacatgtgggaaaatgctagtgaatatttagatggcttcccatttttgttttttttttttttttgctgttgtaaacatcactgcagtgaacatccttgtacatgcatcttggggcatttctaagatttccttagaatcaaccccaagaaggattgacagtcaatggacatactgaattgaagatgctggatctccttggatgaactgccgtctccagaaaggaagggcatgtacatttacaagcccaggagagtgataggagagtgcccttcctcccagtttctgctccatagcacatttttaattccagattctgcaactttagtagccgtgtaggagaccaaaagagaaagtttattaaattcttatttatgtgttcaatttgcatccgccttctccttccccaagctcaaagcgccacaaagaaaacattaagcttgtaactcttggatgtgctcctctgtgagagagggacttaggggaagattcagggaatggagttgaggaaatagtgcagaggtagaagcaggatgcattgtaaaagaaaacctagacatcaggtagtgctgtggagggtttcaaaaccttagtttcagaagaaaggcccttttccatcgtctttcccctggcttcccttttgaatggtagtagaagaagccacagtgaacagttggcatcttttgtttactacccacagacacctggcttggggagcgggggatgttgggggttatgacttttccccttgtttcttattaagccccctcctttgttgttgagtcctccctaaatggtcactcttatttattatgttgaaagtcattgtgtgggctaggatagtcccaaagcatttttgaacacacacacacacacactcacactcattcacaaaaatcactgtcttcccaactaccttgagaccatcttctgttttcttactttccatcattttttcctaaatcagacaggagttaagttctaaaattataggattttgtacctgtcatttttgtgaaaagtgttcctttctccacatgctgcccaatgagggtcctttaagatattttcatcacgttcctcttgctcttgtgttggacaatttcgcacaaatatgttttttgcccaatgatttaagatgctcttaattgcttttactgaagggaaatagaacaccttttaagccaacagctgagcgatttgctatgacaaatctgccactatgcattcacttaatttccaattaatcaaacattcaataaatcattagtataattacacctgttcccttcttgccctagcccattagctcaactcaggcgtcccttcgactggctgtggggaaggtgttcatttgtctgccctggctgggtgcacattcttactccctgtgagcttgagaaatgatgagtaagaaattgtaattatttcaggcaccagaagtttgcttggttttcctcttctctgcttcccactccattgcgtccccaacagcttaagccaacatcatagtggcctagtagcggtggctggttaatttcagcaagcttttcttttttttttaatcatttttattccctgactgtgcctctttgctaattacaccatctccccaggtgagcaataattccctcatcaccatatatctcaagcacagattattaaaataatacagcttatgtcatataaatgtaacagaaagtatcttaaagatgctttattgaaagctggtaaattggttcaacagatgaatgttttaaggcctgtttttaaaaggttgcacaagtataaacccactgaattactgctgcagtttcacacgagcggatgcaattattttaagcatctaactgtgcagaagacagatctgaaaggcaaggagctaaattctccgagattaattaaagggtttcattttgctcttgatttaaaaataaatttcaagcatgcatcacttgttattctgtggaagaatttgcattatggggtttaaaaaaatactgagaacgttaagtttcatgagttcttcatacaatatagctgacagctcttaaaaagaggggttgacctactgttgcagcagcattttctcctacatacttctttctacttttacatttgtgaagggtattaatcttcaaactcatttccaatgtaagattgtgcatttacatgaatctcccataagattgctcctgattcgatctatgcttattgatttaatttcttttacctctcagagccagtggtgctgaagggtttattgtaattacagtgttgcgggtttcggtggaacagttccctggtaacttaagtgtgggtttgattccctctaaactcgctcagcccaggagatactgcggcaagtatcttggaggcagagagctttcaggccagatcagaacgctggctggtacacaaccggaaggtatggggaggctggagagggaacggccgggggctactggccagatggatcgctgttctaacggggcccttttgaggtgaatcacttggcaattttgtgagttggcagacggcacagccacctgtgctcaatgtgaaatgagatacaggtaacctactgatctgaaatatgctgctcaccctttgagagatgggacagtgttgcaagaggtgatttgccctatttgtggggtattggggagggaaccacagcaaaaataccatgagttttgggactgaggggagtccaaatccaagccgtgtgtctctagaactgtagtttctaatttggtttaacttctcaaaactgaaatgtttgtcacttattttccttaacttctcaaagccaaattgttcctctgtaatagcattgtctagaagaacatgattaaagctgcatatgtacttttagttttttaatgactgcattttttaacagtaaaaataaacaggtgaaattaatgcattttatttaacccaaatatccaaagcatgatcatttcagcgtgtgatcaatataaaagatattttacattctttttttcatcctaattttttggaatttattgtgcgtttcatgctgacagtgcacctccatttaaactagccacattccaagtactcagaacctcaaaaggtgatggttactttatctaaaggtgcaggtctggctgatccgttaccggaatagtaccatttgcaactgaaagaagcctaattcaaatgagctacagcaagggaagaaaaattgtctcaagtatggctgaatccagaaacacacctgctgcagtttggaaattccccacatcaaggccctgcttgccctcgggtggcccattagatggcaggaaaatggcccttggcaaccccaagccttaggtggcccttaagtttgtgacctcaggaaatgagagatcctcttcccctgtaactgtagcaaaaacaaatttggtgaggaaaaggaggaaagggacaggcttcatttgtgccaagtgtctgagaagactccttctagaagacagggaggggatgatgggcaaatccatgaaggctacatgtaacgggagtgcaattccccaaagaagctctactgagcggaaaaatggcacatacccattgcaagtgaaatgatacaatctgccttaaaggttgtggtaaggattgcttaggccaaaactctggagtctttcttgacacttctgtttctcaaatatcatgcgtctaatccctgctgcaggaaatcatgttggctttagaatttatccagaattgtattgactgccaccatggggaccatcatcctgagcaggttctgtcttttcttgcctggattatcgcatcctcctcctaactctgctttcactgttttgtctccacacgcccctccccccatggcttctgtctcactgagaataaaagaaaaagtccttgaaatttttcacaaggtccccacattctggtccctaccaactttgtcatctggtatcttgtcctatctctcctgatatggtttgactctgtgtccccactcaaatctcatcttgaatggtaatccccacgtgtcaagggagggacctggtaggaggtgactgggtcatgctgttcttgtggtagagagtgagttctcacaacatatgatggtttaaaagtgtttggcagttctgccctcactctctgtctctcctgacaccatgtaagacatgccttacttccccttcgccttccaccatgattgtaagtttctcgaggcttccccatccgtgtggaactgtgaatcagttaaacttactttattaagtctcaggtatgtctctgtagcagtatgagaatggaccgatacactcctcactgagcccatcctgtctcaccactctcattctagacttcgttttctttcaagatctttgcattgtctatttcctctacctggagaaaccttccccaggtacccctaggtcttattcctacccaatttgaggtctttactcaaaaaccactgtttcagtgaggtattttatattgaaaattgccttctcctacatttcttgtctcccattcttcctttgtagctgtagcattttgtatagtatacgttttagtgattttgttatctcgctctctttctctgtctcacatatactatatggtaaagtccatcaggaaagatatttctgtgtggtgttacattcctctacctagaacagacttattagagaggcttaacaaatatttattgaatgaatgaatgatggaatgtagaggtgctcaatgaacagtagccatcatcattatttactatcagaggctgtttcagctatggtcagcaaggttaaaactcaaaatggaactctgctatgaacccttaagtgtcaatgccatcagtctacaaggtgttgcaaccttctgtcatctgggtctgccaaatacccatttgcgcatgtgtgcccgagaccacgttgttgaaatgttacgtctgtcctgggcgtgaactagataatctgcctaatgactgggccacagtaataggattttcagagttttactgtgtaccatcctaacctttcctctcatctcccgaggactattttctcccagttttttccatctcagtggatggtattatcatctttccagtgacacagggcatcatcttctgaaactcaacacccaagcttcagtccaatgtcatccatggcaagataatataatttaatcattcctttattcagaaaatgtttattaggtcctatcatggcgtaggcactctgataggcatggcagccaaaatgtctcctaagtatctctgaaaacatacccacttctccccacctcccctcctatcacctggcagctggactataaaatattccacttaccagttgatatggtttggctgtgtccccacccaaatttcatcttgaattgtagctctcatcaccctcatgtgtcatgggagggacccagtgggaggtaattgaatcatgggggtgtttttttttttttttttttttttttcctgtgctgttctcatgatagtgaataactctcatgggatctgatggttttataaagagcagttcccctgcacatgctctcttgcctgccgccatgtaagacctgcctttgctcctcctttgctttccaccatgattgtgaggcctccccagccatgtgaaaccatgagtctattaaacctcctttcctttataaattacccagtctcaggtatttcttacagcagtgtgtgagaatggactaatatgccaatcttttgttccctcccagtcttgcgtatcttccatccatcttctgcctagagccaggataatcttttccttctcacatgcaactctgaccatatcatacctgggtttttgtttgtttgtgtaataataacagtcccccattgctcacaggatagtctcaaagtctcacgggagtcttgatgaccaagttaatgccaacctccacatccccatctctcaccaaattctgtttaagctctaatctccagtctaagatttctcaaccttggtattgggacatttagagctgaataatgctgtgctgtaggggtctgtcctgtgcattgtaggatgttgaggagcatccctggcctctacccactagatgcaagtaaaaccccctccccagttgagacaaccacaaatctctccagatattttcaagtgtccctttgtgggcaaaaataaaaatccttcctttctccattgggaacaacagcttcaaacaaaattgaagttacagttgcccaaacatcccctgtcctcccttgtttttagacatttgcagaacctctcttcctctctctttccacatctacctccttagttatggctggcaactcctgctcacccttcatgtttcagttttgacaccaccttctggaaaagcttttttagacttctcccaggtagtagggtgatggcaagatccttggtaagacttggggactgatagcatgtggagaatttggacaggaagatatcatccttttctcagctgggttctgccagaagcagacctgaggcaataattcacatgaaagtagttgatacggttaggctttgtgtacccacgtaaatctcatcttgaattgtaatacccatgtgtggaggaagagaagtcattggattgtgggggtggtttcccccatgccattcttgtgatagtaagtgaattttcacaagatctaatggttttatgaatggtagtttttcctgcactctcacgctctctctctcacctgccaccatgtaagccatgcctgcctcaacttctgccaagattgtaggtttcctgaggcctctccagccatgcagaactgtgagtcaattaaacctctttcccatataaatgacccagtctcaggcatttcattatagtattgtgaaatcggaccaaaacagtggtttatttgggaggaaacactagtgttcatggtggtggtggtagaaaatggtgcaggggagaaaaggccacctgcagaatttattttgtgaagccactgaccactatatggaagtgaagctttatcccactacgggatccttggaaccaacgtacacacatagcttagtattatcctacccaagggcagggggcctggggtacttatactgcaagtctcattagtcattggtagaggggttctgcttttcctgctgcacaggtaggaaatgtgatttcagcatcaagaagaaatgcaggtattgaagatgaacatattacagccaggtccatgtgcactgatatcataaaggtgtaggtaaattggtggggccctggagtgcctcacgtggtggcttcaaggtgttgcatctacacagctgggacatgggcagtaccgttttctaaacagtgcaatttgttaggaggagaaactggcttatttctttgaaccacctgtgctacatccataagaggctgcgtttgaggttctgtttgggaggcagaaaaaagtctctagaaggcacctggaaataaggaagctaaaagtggagacagattggagctgaagacttaagttgtagaggcaccttgaaggaattgtggttaagcctcgaagatgggtaaggtggtcacaggagttggaggtctaggaaggaggggtaactgcagagaaatccatatttgggattagttttgttccttctcctaaagtctgtgtgcggcagcagggagtggtgaatacagtcaagatttgccacttgggactaagccacagtgtttccaaataaagactttaagaaaccctcctcactcataatgaatttaagggctaaaccttatcagtcacacacacagaacaatgaatctttccctgaggcaatgcaggataaagttttaaagttttttttttttctttttttaaccctgttctgttgaattatcttcaaaactgccttagattctgggaccagggtgcggagggacagatggggtgagtgattttgaatgctgcagctttatcttgctgcattataaatatgtgatgccatttaacatagcaagccatcaggttagtaaacaaatgattgccaagtttataattggcaaggaaggaggttataatctataaggagctttgtgtcccaaccaatttattctctaacggaactttattgcctccatcgctgaaaactcccgaagagtcttaagagctaagaatccagattggctgagctagttttctcttgtggtctcctttctggcctcatctcctatccggataaagatacttggaaaacccatttcttgaagatgaagcagcccacctggcccagaaatgcctggtttgttgtttatgggtggtttttatccagtgaattggcaagaagtgaattatgtggaagaatccattttaaaccctttcagctacacaaaattggaaaataaaatattgtgtttcttgagatcatgaaccaatactgtctgggtttcttagggtatgaagcccctttggggtcaaggctcagcctgctactattacagcctcataccctgcttctctcttcctagtatgatgattaagtcaaggatacgacgcaattgaccaggtgtgcagtgcccaactctgtggggccattaacttcacagcctacataaagaagccacttacggttttgtgagctcacactgctcagttgtacatgatggccctggtgacaatatgtgtttttggaattagattggcctgaggcaaattctacagaaaaatagagggaacttagataggttgctttatttgtaaaatagagggttataatacctttctaataatgttgtttacaaaaatgatgcaagaaattgcttctcttagtatgtatttcccctttgcctggattacttaccacaaagccatcgttgcttttcataaacaacttccgatcccttctgtggggtattttccatgaccttccctcttgctccctcatctttgctgtctctgaatataggtatctaactggaaggctggaagtgccatttcaaagcggtggaatttttttttcttcatttgttgttttattttgctttattgcattttccatatttttggctaaatctgttattacctgcccatttcagcaactaaaatctgtttgctttcttgtttacctgcatagaacttactcttccatcttcttggaatggaacttgtctcagaatctttcaggcgattgcctgagtccttcttacagacaggactaacactccccttggaccccaggtatctgcccatgactcagtcttgttcattcagcattttccattcctctggccttgatgtttggttcaccagtgggcatgtaacccaattctatccagttatacttgtgttgggaagggattttttttttccctggggttgtgaaagtaacaggatataagtttgggacagctgatggccgtgttgacattatgtgagtgtaataaactgaatgtttgtatccttccaaaatccatacatggaaatcctaactcccaatgtgatggtattaggaggtggggtctttggaaggccattatatcactagagtggagccctcacaaatgggattagtgcccttataagaagagacagaagagcttgctttctctcttttctctcaaccatgtgaggatacagtgagaaggctgccatgtgcaaaccaagagttcccttcccacacaccaatctgtcagtggattgatcctgggattcctagactctagaaccgtgagaaataaatgtgtgtttaagatgcacggtctatggtattgtgttacagcaactcgactaaaatggtggggaaagccagtgtgaatgcaaagcaaactgttaaaaaaaaaagatacccatttctgacattatttgagtgtcagacttgcatctaattgagccgcaagccttgaacttatcagctttgtgataaatctccccttttttgtgtataaggtagttcaagatgtattactcaactgtgcatcttcctacagagtcttttctactacagcataagaaacttgagagcagaatggtggatctgcatgacacgttttggcacttgttacgttaaactcaaaaactccaaacttggaggtttagaagcagagatttaacaaccaaaaattgtgcatagtcaacctgatgaattaagatagcctgtgagcctgagatgctgaagtcttttttttttttttacccagaaatacggtgattttttacatgtcacatcctggatcgactctctgtcagctcagcaagtgtcttcagagctgacaagtgataaaccagttgaaagtgccagtcacattgtttggttattgataatgctgctgtaccagggatgtgtcattagtatgtgtttacgggctgcaattctcaacatggacccagcagaaaatattgggtacttcaggcattcttgttatttacccagatggtgtttcgtgggataccccctgcctagagcagatctggatatgtgtctacactggttccaaggatcctatactgggataaagcttcagttccacatagtggtcagtggcttcacaaaataaattctgtaggtggccttctctcccctgcaccattttctaccaccaccaccgtcatcaccaccatcatcactggtgtttcatcccaaataaacaggtgcatttctttgtctaattttagagccagtggctacttcttacccatctggtgggtattttttacagaagacctgatcactgagttccttgcaaagatgtccccatcttttgcttccattgtctcatcagtagaaactcacaacatgaaataataacagcaattaatgtttatatattggtcttttccatatggtaggtatgttggcactattccacgtgctggggttggagtggtgaatggaacagacgtgcccttgtctttagtaaatacactacaacttgtatattttagtgggagagatagatgataaggaagtaactctagctgaaaaatataattacaagttttgaaaagtggtgtaaggaagtccacaaggtaatgcgagtaagagtaattgatgatggtgataggtgttcacggttggacagagtcttgagaacaattagttccaaagtgaaaccacctttaaggaggcagcattttcgtggagacctgacatggtttggatttgtgtccccgcccaaatctcatgttaagttgtaatccccaatattggaggaggagcctggtgggaggcaattcgatcatgggaacggacttcccccttgctgtttttgtgatagtgagtgaggtctcacaagatctggttgttgaaaagtgtgtaccactcactgaaggtaaccatagtaacagcaaaatcccaaatgagttaaactcacaactaggttgactccagtctccgcataaacacactggcagaagagatgtgcatgtttctttctttttttcttatctttttttttgttgttgttgcttgttttttgagacagagtcttgtactgttgcctaggctggagtgcagtggcatgatctcagcttgctgcagcttcaacctccggggctcaaacaatcctcccacctcagcttcccaagtagcttctgggactacaggtgtatttcaacgtgcctggctaaatttttatattttttgtacagatgagactttgccatgttgcccaggctggtcttgaactcctgggctcaagggatttacttgccttgatctcccaaagtggtgggattataggcatgagccatagtgcctggctgagatgtgtacatatttctatgcaaaaatgctattgacttcagtcttcactactttccttcatagtattcaatattaaatagtatttaaatagaaatactaggattcaatattcaacagaaaaaaagaggaaaaaatagcccacttagacaaagcaatcacatcaattaaactcagaaaagaccccagtgttaaaattatcagggaataaatttaaaataactattactaatagtttaaaagttttaaagcatagtttcctcatcttcaaaataacctgtttttttttttttgagacagagtcttgctctgtcacccaggatggggtgcagtggcatgatcttggctcactgttagctccacctcctgggttcatgccattcttctgcctcagcctctggagtagctgggactacaggtgcccatcaccacgcccggctaattttttttttttgtatttttagtagagatggggtttcaccatgttagctaggatggtcttgatctcctgaccttgtgatccacccaccttggcctcccaaagtgatgggattacaggcgtgagccaccgcacttggccaaaatgatggttttttaaagtgccaaattcttctggttattgtgcatattaaatgacataatggagcccgggcatggctgctcacacctgtaatctcagcactttgggaagcctgggcgggcggatcacctgaggtcaggagttcgagaccagcctggccatcatggtgaaaacccatctctactaaaaatacaagaaattagccgggggtgatggcaggcgtctataatcccagctacctgggaggctgaggcaggagaatcgcttgaacctgggaggcagaggttgcagtgagccaagatcatgccactgcactacaccctgggcgacagtgtgagactccatctgaaaagaataaaataaataaataaataaataacaaaatgttagtaaagtgcatgcttagcaaaatatctgacacagggtaaggatttagtaaatgacagtaattgtagtccttatcaccttggatacttaatgaaatactgctgaatgttcaagaaaaaaaaaagtgtgtacttcttcccccttcactctttttctcctgtttctgctacgtaagacatgccagcttcccttttgccttctgccctaattgaaagtttcctcagtcttcctagccatgctacctttacagactgcagaactgtgaaccatgtaaatctctttctttataaattacccactctcaggtagttctttatagcattgcaagaatggactcatacacgacctatgtgttcaagaggagccagccagggataattcaggaaagggtgttacaggcagcaggaacagcaaaggcagaggccctgagctggaaggagcatggtatgatggagaaacagaagtgagaggggtgctgctggagaatagttggggagaaagagacgtgtcgggagaatagttggtgagaaggagacatgtgtcaggaagagctagagagaccagggtggtgggtcagctgggacacacatgaatgattggaaacatgagcttcatttctgagtgtgccaccttttttattcttcaaataggtgataaagtaggtacttctgaaggattaaggatgttgctgaagtgtatcccacaagtgaatatcagaaccatgattcattccctctctttgcacaatccatccattttaccttaacatgatgctaccatgttattaattggttttgaagctccaggtacattaatactgggacagtattaattcctacttaacataaggatcatgagggctaagatgaggtcacgaatatgcagcttttatgctggtggtcaggcatagtctgttcacaataaacagtagaatattgcctcttctgatagctcagtgtttgctttatgtaaccattttaaaaaatgtaattgtggtaaagtacacgtaacataaaacatatcatgttggccgggcacggtggctcactcctataatcccagtactttggaaggccaaggcaggtggatcacctgaggtcaggattttgagaccagtctggccaacatggtaaaaccctgtctgtactaaaactacaaaaattagctgggcatggtggcgggtgcctgtaatcccaactacttgggaggccaaggcaagggaatcacttgaacccgggaggcggaggttacagtgagccgagatcatgccactgcactccagcctgggggacagagcgagactctgtctcaaaaacaacaacaacaaaaccgtgttaaccatttttaagtgtacagttctgtaatgttaaatgcattcatatttttgtataaccaatctgcagaactttttcatcttgtaagatggaagctttatgtttgttaaataacagctccccattctccttaccctccagctcctggcaaccaccattccactttccctctttgtgaattcctattctagctacctcatacatgagtagaatcacacagcgtttgtctttttgtgactgtcttatttaattcattaatgtatttgtttaattaattaattaattaattttttgacccaggcactggccctgcagctgcttccttttgggcgtggaaattcccactcatttcagggatcacgctcacacgcctattgcaggagtattagtaagcaccccccaccagcccacattatccccccaaaataacgagacctcacctggcctctgcatttccacatccctgctcaaagccaaatccattcctgctccctcgccctgtcctaaggttcatctgtattacagcatgtatcaaaatttccttcctatttaaggttaaatggtatttcctcctatgtatctactgatgaacgcttggattgctttcacctttgggctattatgaataatactggtataagcgcggttgcacagatatctctctgggaccctgctttccattcctgtggtacatacccaaaaatggaattaccagatcatgtgatatttctagttttaagttttgaaggaaccactatcctgttttccaagaggctaaaccgttttgcatttccacccacagtgcctaagagtttccacttctccacagcctcgccaacttttgttattttctgtttttgtttgcttgtttgttttggcggtagcctttctaacaggtgtgaggaggttgctctaagtcatcttggtcatgtccttaggaagtatattatttgcagagcagctggaaacatctcattctcttccatccactcctttctgatgaaagcggcatattccattgatggaatatttaccatgtagataaatacttggcattttgccaagtcattttgtatactcagtaccatgtttgtgtgatattaatgagaacctacagacttctttagaataatcaaggggtccttaagtttctgtcttgtgtacttgaaaatatccaactggaaaccatttaaatatggctaaaattctgtgtctctcttgcagttgcacaacccataattaaatgatttgtagaagcagtctgaattaagggccccgttcatcaatactacatgaattatgtaggcatatcttcatttttacattatttatctcagcggccagatgggtacattggctgcaatattcatcagtaagaaatccaaatgtagctttggcacactgacatctgtgcctggtctggccccccgtggggtagagtgaatatttgtggttggggactagggggccctctgcttctaggcaagtcaggagttctgcaagtgatggtatttgacactttatcagtcacctcctaagtagctcccatcagagataagtggaaaggatctgagagctacccaggctttggggaggggatgggcaatgtcccatgagtggtgatgtggacaccagagttttcacaacgtgtttgtcttggttgctgatgctctgtaaaactcagtagtagctaatatttaggaaggcagtgtaatatagtggataaaagtgtgggcattggggtttacattgtggctttcccactaatactgtgagactttgggcaagcagtttcttcgtgtttcttacctggacaatcatttaatataggcacctactgtatcagagtggtcgtgagaattcaccgagcataggcaggttataacattgagtatagcatgcaactgtggattaaaaagataaagacttaaagataccactatggagttatctcaaagatacattattggtgaacacacaaaagggcataatgttatgtattatagttttgatctgggtagaaaaaataatacaattatagattgtgtttgtatgtgcataacatttctggaaggttctaacacaagtcattggtttactttggagaagtggatggcagtaggggatatcttgagtgagccctgttgtatattgtgatctttgttttaattttacgatttgcatatattagtatttttgaggagcaaatagtctgattttgaaaacaaggaatgagttacagaaagctgcatctgtctcgtgaagattttttttttctttgcagttagacaggaacctggtgatgaggctcccctagacttctggagagtcttccagctacgtactcaagatcttagcttactgacctgtatgttctgcacgaggttctcaccattgtttccagctccacaccctggccagatacagagcactcacccagtcatgatccatcaggaaaataggaagttggaagtgggctccaccttggcccattgctgagggcaagtaggattttcacttaaccgtttgggagaagtggatatttgcctctactatggtctgaatatttgtgtaccctgaacatttatatgaaatatttataccccgggtgatagtattaggaggtgatgaggccatggtggcagggacttcatgaatgggattagtgccattataaaagaggctttacagacctccttgccttgttgtcctgatatgaggacggcgagaaggcatcttccattttttttttttttttttgagttggagtttcactcttgtcacccatgctggtgtgcagtggtgcaatctctgctgactgtaacctctgcctcctggcttcaagcagttctcttgcctcagcctccccagttggtgggattacaggtgcactccagcatgcccagcaaatttttatatttttagtagagacaggtttcaccatgttgccaggctggtctcgaactcctgacctcaggtgatccacccacctcgtcctcccaaagtgctgggattaaaggcattagccaccacacctggctgccatcttctgtggacgaggaagcaggccctcaccagacaccaaatctaccaggatcttgatcttggacttcccggcctccagaactataagaaaataaatttctgttatttagaagccacccagtctgtggaattttgttatagcagcccgaatagactaagactgcctcaaagtcaacatttaagagttcagattagaccatatagggtaacttttttttttaattttaatttttattctaagttctggggtacacttgcagaatgtgcaggtttgttacataagtaaatgtgtaccattgtgatttgcttcacctatcaacccatcacctaggtgtgcattagttatttttcctaatgctctgcctcccccaaagccatatagggtaacttcctgaccttgctgtagcatttgtaaactgtcatggcagtagtgggagtgtcttttggcatgcaaatgcattacaaatagtgtataatgagtaatggggacagccaggagtcacttttgttgccctcttggttttggctagctttttttttttttttcttttttttttgagacaaagtcttgctctgtcgcccttgctggagtgcagtggtgcgatctcggctcactgcaagctctgcgtcccgggttcacgccattctcctgcctcagcctcccgagtaactgggactgcaggcacccgccaccatgcccagctaatttttttgtatttttagtagggacagggtttcaccgtgttagccaggatggtctggatctcctgacctcgtgatccacccacctcggcctcccaaagtgctgggattacaggtttgagccaccgcgcccggccggttttggctagctttttaaggcatctttttaccaacgaggtctttgtgacctgtacctggtgccgaccatctgtcacatcctgtgactcacaatccccaacctaccgtgaatgcagcccagtgggtctcagccttaggggatgaaccctcagttttgggaattgcccacccctttcctggaaaactcacaaataatccaccccctgtttagcatataatcaagagataatcataaaaatatccaaccatcagctcttggggctgctatgcctatggagtagtcattctttattccttttaatttcttaatacatttgcttttacttaaaaagaagagttcagattagttcttctaaaactctatattcagggtagatttccatctgttttctttttctataaatgaaccaaaaatgttgaaaattctatcattttaagccattttctggcgccgtgtgtgctcttcaagcattgggttgtgcaatactgtttgcctttttccagcagtgtttctcatttgatttatcagagatgatacttggtaattcagtttgatattgtcccctgtatctgatgataaacacttgagggaaaccaggaaatctattttttatgttaaataataacactggccctttcattatcctttcagcattgcaaatcaccctttctgtctcggcaaagagagaggaattaagatttgttccgtgttgactcctacgtgattatgttattcagtgttaaatatgagagaactttgttacacagagccaggagggggcagtaaatttccttttttactgttattaaaaatggatcctgcgtttcatgcatagcaagatctcacccgtttgctctagaataccactaattcctaccccctaccccagcaagggaaatttttgaattcattgtgactctggttttatgtaacatttccattaggttttaagtagtgtgctttcaaattactacctgtaaagaggcaaaagcaaatttttgcatttgtaaaaaaataataaataaaaataaaacgctattttttctttttttttttttaactttgcaaaggagataaaatcacgacttgtcttaagatctgctttagctcttcccgttcccaagtaggtgaaggtggaactatcactagataaactgaaatcaaagtacagtgcctggacatgttcaggttcttgtgaacaatgagagaaggcaaggatgcctttaatgtacatagctgctttcctggtcatattctatcagttcagcaaacactatgatttcaaacaggtgtgcatgcccagagaactagcttgctgatcagcgtctggactggacccctgggcttgcctgtgcgttttctcttccttctgctgtggctgctgcttcctaaaacttgtgtctttgaatatcattaacttacgtaattgctatgttccctaccagggtacctaatatatctggctagttttaaggaacaccaagttctctctgtgggatgatttgggggtggcttgggaattattattggctgtgctataaatggctgaggagggaaataaaggacactttcaggacacaattaacactttctaatggcacagcctatgtgctacccagagactgggaggcagtgcagacccagagaaataatgacatacgatgagagcgcctcatgaccttcaggtatttggactgaacacacacacacacagacacagagagagacacacaaaacacacacagacacacataaatatatgtgtgtgtgtgtatatataaaacatgtatatatttgccttcaaaagtcgcaattccatagaaagaagaggtgagactcactatcctgcaattctgacaatccctcaacctgcagactggacatttctggtgacttctaaaaggtaataataggttaatgtaaaattaattgcgttttttgccatttctttcagtagaaaaaaaaacgcaattgcttttgcaccaacctaatagaaactatctaaagaatattttcttaagtatccaggttctcattagtcttcattttacaattgttcctggtttttttttctttttttccttcatattcccccgctgcttccacctacaccagatgaagcacagggcaaaaactggattatacgcaaattgtacactgatttattagcgtgagccaggagtttaatgaggggagagggaaccgtacaaacagctcttggggcctatgcttgagtggagttgtgccgccatactaggtttcagtatgaatttgggatagggtcttctaccccctccttccttaaggtagaaatgaggaatgtgtctacttacaaatgtccctggtacacctatcaaatgggctcacacgtgtgagtctctccatgaagtaccctgctgagttcagtagcatccgtccagtatttgttttgtcaggcatttgaggtctttaatgttttccaggacatttgactttgtttctctgttcctcctcgggcatgttagtggcattaacttacagtccagtatttacctgattccattttgaaatcatacagcctgttttggaaggctagttctactacgtacgcacagagatgaagggaagaaaattattttggtctctttaaattccctatctgtaaattgaagaaattgtagtatttccatcctcacaggtttgttttgagatctaagtaacataatgcagtcaggattttagcatagagctagccaccaagtgaacttcaataaatggttaatattttatcattagttttgacttttgttttcatatccattcattatgctttttggaaaattacttcaagcagtgtcacttcttacggtcattgtatcaccttaagtgaagcttctgcaggactgctatattgtggtatttatgcctttaagcagttttcagcttggggaaatacaaggttgcagtttacttatcaaatagtgaaaaacgtaacttgagcaaatttctctcctgtataaacagttaaatcccaatgtcttgtcgttgtttcttcttctagaagaggttattccttgagcccagttgtattttgtatgtttcataaccttggaaattgttcatctctatgaagtaatcccttttattacataatataaagggaagataaagtttttaattctcaacgcatctgaagtggtgacatgtagcaaacagctcattatcccccacaaaaagcacaattactcaatatagggaagcagtgctttcagaagctgcctcatattggagctgccccacgctggctaatgttggatattgattctgaataattcaaatagcaataaaattgggttttcatgacagtcaatcagaggcattttatatttaatgctcaatagaagaaacacggtgtctccttaccttctgaatttcaaagccattaaactaattgtaggtcattatgtgaaatttatctgcataattggaatagttgatctaattcatgtagcattcaaaacagtggccagagaagaactgatgaatttttagataatgatatatatatagtacatgtatacatatgcatacatacgcacacgtatatttgtatacatacacacacttttagtcaaagtagtgtcactttaccagcattcatttttgttaatacagtcaacaaatcatacggggataactttaaataattcatttgatcctgtttctcacatattcccagtggcctcagaagtgaatagcttctgttgaaatggagatactaaactaaggagttttgttctttatatgattttgctgatattttcttcttagttttcatctgtctttccaaaatagacttacctgggagatatatatgattatatgtatataattggggtcaccagaccccagggattctgatttaatttacttgagattgggacctgacgatcaagatttgtttagaagctcctcagttgattctactgtatagcatagagtgagaatcaaggtaaatctaattcagtcattcactcactcattaataaaatagtttatcaagtaccttttatcttctgcagtcttacaggcgttctgacggctaaaaggtgaggaagatagtattgtaggagccttcccagcaatccattaaaatgttttaaagtgccagtttagacatagaaacaaagaagatgtttatatacagctgcctggaaagcctaatacttctgtctctgggaatattatcaaaaccctagagggaaatgggcttctaaagggttcttggctgtgtgtagaaagtacctcattctcttctaactttagacttgcaacccttaatatatgacctcagattagtttgttggaaggtagagtgacatatgaaagcagaattccaccttacttgggagttgggtcttaaagtcacactctgtgttcacttaagttgagtttgtttctagcatgtgcaaagcagagatatttctcctggtaaatgctgaagtatcgtgggacaaatggagtttggaagaaagctgcttagaaacgagaatggcccaggagatacaacatgtaaaacttgtacaggatgcccgactccgagaagagataatggctgatcaaaaactcagatcctgatgccaacaaatgactatacttgttgaatatttttgtctaggaagtaatttggagagcttggaaataatcatggagataatcttgatgttctttatatattcccaggctgcctgttagaaagacatctctccaccttggcaattcctgcttcctttgacttaagtatttgcttccctaaaagaagccttaaataattataactctttacccataaggagaagaggaggggacataggaacaaagcctgagcaaatatatatggttcatatagggagatggtagaaccgtacaccagtgtacggccctaaggatgggggtagcaatggtgagaatcccttgaatctcattcttgcccaatttagaataagaaatacattatatagtaagcagtaagcatgtggaatctctctctctctgtctctatcatctgtgcatctgtcatctctctatctcatctatatctaatctatcaatttatcaaattatctaatctatccatctatctaattacctaactgtctaatctatctatccatctatctacctgtctacctaatctgtctatcaatctatgtatctatgcatctatgtatctgcctatctacagtcctgaaaaagggattggattcagagatgatagtgatatcattgtttaatgtgaagactggtcattttgtggaaaatcttcaatcatggtgaaataacacctcttagatgaaatgccactgtccaaacgatttttaaggtcactgctaggggcaaacagacaaaaccgattatttagtgggttaggaattctagagttggaagatggcttagatttcatttactaggagtttctcatatgtggctgaggagcagagccgcaaggggactgtactaaagattcccagaccccaccctgcttccttgaattagaattaccaaatatggggtggggagatttctatctttgacaggttccccagctagctccacaatgatcaagaaacagcagtgaggaaacactgcttttgttagtatcattgatgtcagagatcacaaaagagaggttatgtttgcaacccagatcagaagccagattataaattcctacctcaggaatatcctttacctttggaaaactggttatattcctcccttggaaagcctgaattagaagatgaatacagagggactgctgaggacagctagaattatctaagatgcaaaaatacagggaagatacatatcagatcctagaggaactaaatccagatactgaaggctaatgggaaatggtaagatgaggtgggaagtagagttctgcacaactaaaaaggacacaaaaatattgccagaagcacaggcagatactgaccatatatcattgtggatcgttgatgtctagggcacgactatactttagaaacaggggatcagtgacctcacatctcatcttttgtagcatactgctactctctgtccttcatcctgtgggtttgccatctttttgtgctcttgcagaattctagctgcgagtatctgtgtctcagttcttgagagtatttctcaggattatgggaagttgctttgcccatgcacaataggagaccagaattgtgaggcaattaatactccagggaatagcccttaactaatggctcttgggagctggagtgtaaacaccccagctccctcactccatgggtaggataatgctgaggcacacgttttgaaagttttcccacatgactaggctcattgtatatctggcttcttagtccatcctttattacaggatgcttttttcttccctgtgctaatttctccatttctcccttccccactgctgtttcctaccttccaaaatgaacaacgttttctaaaatccttggctcattgtctgcctctaggggaatccaaacaaacaaagtatctgggtcttcctatgttttcttgcacagccagttaaaatctgacatctaggagtaatgtatgaaattagctgagcctactaaaaccaaatttgaatcaaaagggaagattttttttaaaggatctaggtaaattctgggaactgtattggaatgacttaagctatggcttgagatctatccctcttttaacctttccttcatttctctttcagtcttccctttgcatctgattcttctgcatagtttctggtctctttcccctatacatctgatccctccatctttccaaagattgactttccctgcttactcacagttgctgcttctctgcagcctcagctggcatgtaactggattacagtggtgttagatgtggccaagaatccacagtgaaattccagctccagaattcaccgtctcggccccaggctcctgttcagattctcacgagagagtgagtctctgacagatgcagcattccttgctgggaatcagcttccccaaggcaggtgacctctctggcccaagcacctgcactgcacctgcactggggagtttattgaggatggtgaggtcacctgattcattgagtatctcttccagggggatgggcttaggatcgtaatctagaaaacatttagtgtagcaggcaattgcttttcatcctgaataggcagactttccaccacgattaatgcacgtagtaggtctgcaaggcagggaccctctgtgttaatgtaaggacagtgacattggagagaagagcaaggtgaatgcttagcatttacatagtatgttgacgtcctctgttgcctaaagcacataagcctgatttatgccatgggagaactagcacattctgccagtgcctctgtacatgctgcacacctacatttttgaagagtaaataatgaggtggagtttttttgttcatgtttttgttttaccttggacagccattatgtaaacttttcacaacaaatttgcatctgaaagtttgttgatccttgtgttatatttcatgacaaatgatgaaaatgctaatttctgaataaagtaagagctacttttacacatttatttgcagaaggaattataatttctttattggcattttttaaaggttaggtacatagtctttttaaaaattaacttattaagagacgtcaacatctagggctccctcttacataaaaagatgctgaaaacagaaatatatgaatataagcactgttgaatgcaaatatcaaaatgtgaataatgagaacagccaacccctcatctcccataggtcattagaaagtgcttcttcactatttatttattagcaggtgccagagccctggcaaactcccttttttgaaatttggccttcagtgtgatagaaacaaatatgacttgggatgatagaaacagaaatatgacttgggcatatatgtagtccttccatccttccataatccagatatgctgaactgatctgtacacccatgtgtcagagcaaagcctgtgcctgtcagctgaacccactcagtcctacagccttcctgaaaattaaattaaaaaaggttttttggtggcttttataagggcaatagcagaatttgctaggtcaagctagtcaacatttttataatgaaccatttaataattaatatgtagcaaatataaataatggttgtagcctgcagtagttaaaaacctgagatccttacaggaagtagccaggggtggtggtgtgcacctgtagtcccagctactcaggaggctgagatgggcaggtcgcatgagcccagaaggttgaggctgcagtgaactgagatcacaccactgcactccagcccgggcgaaagagcgagaccctgccttaaaaaaaaattctgacctctgaaatctgacaaagctgggttctactaccatctctgtgacttgctgctggaaagcaggagctcactccagagctgacgttcacccagaacgcagggccagtgttggttctgattgtcagcgctatgctgtacagggtttcagttcttagatagtctgaatagcatcgttgtctatctttaagggttgccataaagacaaagtttataggacacagtgttcagtccctgccacatcattacagtttaacacgtgcttatgtttcttgccatggtcattttagagaacttataccccactgcctgggtatgaaattccagtcttattaccagaattgcacagggatccgccagaattatacagggttcaacaggtttatttgacgttttttgtgcttttgatttcagcccacatccgtgcagctctgcaattgtatgatgtctgacccctctgtccaactcccattgaatatctatgaatgccctttgttaagcagtgtgcatgcgagggctggtatagagatatttgctttgttcagaaggcaaaaagactatcctctgggctcagttttgaattcacaagattgctaatcattgatcgtaacagctctaatttactgaacactgacaattatgtagccatttcctttacgtggattatctcatttaatcctcatgataaaggtcatggtattgcctcattacagatgaggacatgggtccaggaagttaaaccacttacttgaattctcccaaagtacaaatggcccaactaggagttcagtccatgtaattaagactgtgctcttaactactctcctaaactcagtgggactaggtctctattcctcagacattcttttctttgtgatagtttctcctctcattctacacatattttatcttatttgtgagggaagagtcagaaagcagcactagacttcagttcctctctcctttcttttcctccttttacccctatccaatcaggacaatataagttgtacttaagatttgtggaaaatattttttacgaaatctagatgcataaagcaaaacaggtgcagcaatgaaaagatgagtcattttcaatagttcttgacgcctagtaaaggttatcagaatgtattaggttgtgttgcctcgcttgagcccaggagtttaagactggcatgggcaacacagtgagactgtgtttctataatttttttttaaagtagcctgttgtggtagcacagtgtatgtctgtgttctcagctacttggaagactgaggtggagggatcacttgagccagggaagtcaaggcttcagcgagccatgattaaacaactgtatacactccagcctgggcagcagagtgagaccctgtctcaacaaaaacaacaacaacatcaacaacaacaacatcaacaacgaaaaccaaactggtggcttattgctagatgcacatgatttaatagaaagggtatggtttgggagttaagtacacttgcctcctacccaactcagccactcaccagtgggttcatgttggtggaattacttaaactctaaacctggttacttagtgccgtcagctagggagcttgtacctactattcagggctttacttttaaggattggaaaattgtaaataggtaaatggatagatatttttctgtcttagtctctgcagtgcctgtcggagactaaatcttcagagtatacatatttcaacagttatttatttggagacgtttgagtggcagctactgttgtgtcttttaactatttctcgtccccatggatgtgacttgtatttgcttatgtcccattgcatggctaaaataacttgaaacagaagttgtgtaacattggatcgatcacaaaatgtttgggtaacaatgctgagactctctcagatccctagggttgcatttcccctagaaactgaatttggttatgaaaagccccagtgcaggagtctaccatgatagttcccaagtggcatgggtggtgatctgtggttcctctccccctgtgaagaacacagacatgaggaaatgaatccttgaggcggagcattggttacataattcacaggccctccttctgagacctctggaaataagcagatggttgaagaatgagggagtttttgtcgccattttttttttgccttttgctttaatttttggaataaataaggtttgcttccctactgggcctgctcaagggtaattaacttcttctttttgaaagggatttagaattttcagcatggttaccccaatatttttctgatctatccagtattacacaatttttgttcaaattattttagccatccaaggagacataaatacaatttatgtccatgttgttaccatggaaaaccagtttattttattttattaattttttaaattttatttttccataagttattggggtacagttggtatttgcatacacgagtaagttctttagtggtgatttgtgagattttggtgcacccatcactgcatcatattgtcttttatccctcacccctctactcttccccccaagtccccaaagtccattgtatcattcttatgcctttgcattctcatagcttagctcccacatatcagtgagaaaatatcatgtttggttttccattcctgagttacatcacttagagtaatagtctctaatctcatccatgtcattgcaaatgctgttaattcattcgtttttatggctaagtagtattgcatcatatatatacatacctcaatttctttattcactcattgagtaatgggcatttggattggttccacgattttgcagttgtgaattgtgccactataaacatgcatgtgcaagtatctttttcaaataatgacatcttttcatctgggtagatacccagtagtgggattgctggatcaaatggtagttctacttttagttccttaatgaatctccacactgggaaaaccagtttagaaggacaggttgtgatttgtagcaggtggtggttctgaccatgtatggaatgctgtattcatacatctgaattccagatgtggataccctggaaagtgggatacctagagtctgaagcaattgatttggagcctaggtatagacttagcagggaggagtgctgtgatggattggtgatgtctgctgtgaagttagcatcgggaagcgacagcctgtgtgccctgtattcgccacttatccctgacacgggaaccgtctgaaaagaggagcctcatttaagcagtattcagtgaacatctaccatgtgtcagatacttcagtgggcagtgaaaaatcagttctgagtaagatagtccctgccttcattgggtttacaatagaggaaacaacagaggcaaagctgtaaagaatattggcaagaatggtagatatttggctataggtcaagcaaaaaataactcaatgtaatttaaataaagggttatgatatttttgcatttccccgtatttcttctgacaaaagttcacttgtgattatccctacccttatatgttatttatagatttcttgtttagaagtataaaaatgcatcagttttatctgttgtttaattatcaggtaaagactagaagaaatattgggccttcatgtaagtgtgcatcacagtattaaaatagaattcaaatatttgaaagttaaaaagaacagacatgttactccttgtccagttcagatggccaaaacagctactacgtggtggctatgaactttctggaagtcattgctgctcaacatcagttttaaatctggactctgcttctaggatgtgttttctcgcccgaggctcatttgatgtgagggcttagcaaataaatacagttgggaagagtgaagagtgttaatcaggttcaatataggctaggctttttcctcaaaatgtcccagagccttaggttggatgaatgtctaggtacacaaatgatatatgggatttaaataatagtccatttattaataagaggaaaggtatcttatatcaagattgtttatatttcatttagttaactccttttatttgggacattgcagacttttcctaaacaaaatgtactataatattttcgagatgggggaagccatgaagcctaagttacatttaaaaatttgttaaataagataatgagtaaacattcccagcacaatgcttgagccagagaaaagtgctaaataaattctaactattgccactgggaataataatgtgtgtctgcaacagaaaacaaaaacacaaaggacttgtctcttttttttttgcggtaattcttaaaaaaaaaaaaaagtcaggcattttcctcttgtcaagatggtgtaatagggaccagatgtaacctctcatcttaaatgactgtatgatgatcaaaacacatggaacaatggtttgcataacactgtacatcaaatagtaatggacagcaatccttgacaggagcaaaggatgtgagtcctttgattgccccagcttactgctttaagagtttccataaggagaggaggggaactgagatgaagcctggagtactccctgtattgaggaagtggaactgagggtccggggagcaaggcacctgtcattctgagtatagagcatcagagtggagagtaggagcccaggagagtatttataggaattctgaatgtgtatgtatcgaataaaagagctgtaaaatctgtgaagcaaaaacatgtagaacataaaaaaacagatatatgaacccacagttataattgtaaacctcaacatccatctcgcaacaatttatagaatgactgtataggacataaggaaggatagagaagaactcaccaccatcaaccaacaagatgtcattgacaattacagaaccctttaccccaaaagagcagaatacacattcttttaaggagcccatagagcatataccttgagagaccatgtcctaggccataaaatagacatcagcaaatgtaaagacagtgaaatcttggggtgtggtctctgacaacagtagaatcaaactagaaattaattcataaagagaacaggaaaaaatcccaaacacttggaagctaaacagtaaacttctcagtaatccatgagttgaaaatgaagtctcataatacattttaaaaatgacattgaacttaatgaaaataaacatacagtgtatcaaaatgtgtgtgtcgcagccaaagcagtcattagagggaaatgtatacccctaaatgctttcaatttaaaaatgacaattctaaaatcaataatgtaagctcctacttcagacaaaaatagggaaagaagagctaaataaacctaaagcaagcagcagagaggaaataataaaaattggagcaaaagtcaatgaaattgaaaacagaaaaacaagagagaaatgctagttctttaaaaatatagaagaaaatggcaaacttctagtagggatgatagaaaaaaaaaaagaagggaataattacccatatcaggagagaaggtgagaatattactatagaccctgcagacattaaaaggataataagagagtactctgaacagctctgcacttactcatttgagagcttaaaccaattctcttgaaaagcacaaactgcaattcacccaatatgcaatagataatttgaatgaccctataactattaaggaaattgaattcataatttaacatcccccctccccccaccccaagggaatctccggtctaaatggtttcactggagaattctacccatatttttaaaacatttaacaccaattcttcaaaatatcttctagaaaatagaaggtgggccaggtggggtggctcatgcctgtaatcccagcactttgggaggccgaggtgggtggatcacatgaggtcacgagttcgagaccagcttggccaacatggtgaaaccccatctctactaaaaatacaaaaattagctgggcgtggtggcaggtgcctgtagtctcggctcctcgggaggctgaggcaggagaattgcttgaacctgggaggcagaggttgcagtgagccaagattgcaccacttcactccagcctgggtgacagagcaagactctgtcttaagaataaaacgtggtggtccacattccactttattttatgaagccattacactctggtcacaaaactggacaaagaaagtaacaaaagaaacaagaaaactgcaaatcaatatccctgataaatatagaattaacactatttaaaacattttcaaatagaatctaacaatatataaaaagacttatgcaccccaacctaatgaggaatagtccagtaatacaatactaattcagtatttgaaaatcaattgatgttattcactataccgataggttcaagaagaaaaatcacatgctcacattagctgatgcaggaaaacatttgacaaaattgatacacaaccagaagtctcagaaaaaaataagaatcgataacagttttcttaactcgataaaggatatgtgcaaaaaacctacatctaatattgtgtataatggtacaaatgaatgatttccccttaaatacaggaacaagacaccactgctattcaacatagtagggaatttctaaacagtgcaataagacaagaaatataaataaaaggcatacagattaaaataaagaaataaaactatccttattagtggattccatggttatagagtaaacaccaaaaatttaaaacccacacacattttgtggactgacaagttagctcaccaaagtcacaggatatgaaatcacattgccaaaaacagtttctaaatttcttacagtaaacagataaaagcaacttaaaatacaatacaattttaatcacccagaaaaaagggaaatatttaggtgtgcatctaacaggacttgtatgctgaaaattatcaaatgctgatgaaaaaggccaacatgtaaatagatggaaaagcacagtgtgttcatggattgaaagactccactttgtaaagatgccatttctgctcaaattgatacacagaggtaatgcaatcatttcaaaatatcagcagagtttttaaaaataaatatagacaagattatctcaaaatttgaatagaaaagcaaagaaactagagttgttaacacaattttgaaaaataagaatcaggtgggacaaaccagtctacctagtttcaagacgttatgtaactccagtcatcatcgctatgtggtatttgcttagatgtagacacctaaatcaatggaagggaagagaagacactgaaatagccccagacaacattgaccagctgatttttgccagtaatgcaaaagcaatttaatgggggaagtataatctttacaacaatggtgctggaacaattggctatttataggcaaaataataataataaataataaatcttgacctaaacttcacatctcataaaaattagctcaaaatggatcgtaggttaaattgaaaacataaaactataaaactttcaggcaatcctataggaaaaatatctttcgaacttagagctcggtgacatgccaccaagggtctataaaagaaaaaaatgataaattagacttcatcaaaatttggctggacggggtggctcatgcctgtaataccagcactttgggaggctgatagcaggtggataacctgaggtcaggagttcgagaccagcctggctaacatggcgaaaccctgtctgtattaaaagtacaaattttagccaggctaactttggtggtgcgcacctgtaatcccagctacttgggaggctgaggtaggagaatcgcttgaactgcggaggtggaggttgcggtgagccgagatcatgccactgcactccagcctgggcgacagagccagactcagtctcaaaaaaaaaaaaaaaattaaggatgtggtctctgaacaatcctgttaagatattggaaagaaaagctataatgtggaagaaaatacttgcaaatttcatatctaataaagaattaatatctataaatttatgaagaagtgaaatggtggttaccagaaactggaagggtaaagggttagagaaatgtttgtcaaagcatacaaagttttagttagataggaggaataagctcaatagatcaattgtacaacatagtgatagactgtagttaataattctgtattatattcttgaaaatcattaacagagtagatttcaaatgttttcaccacaaaaattataagtgtgtgtggttctgcatatgttcattaacttgagttagccattctacagtgtatacatttttcaaaacatcatgttgtacgtgataaatatatacagttattattgtcaattttaaaatgtcaaagagtgaaaaccaatccatttagaaaatctttttaaagtgacttgaagaaatattttaccaaagaggatatatggaggcaatcaagaacatggaaagaattcggcattactagctattagggaaatgcagattaagaatataataacatatcattatacacatgttaaacaggtaaaatttaagatagaaactatcaaatatttacaaggacgcatagaaagtgtgtctctcatatactgatgatggcaatgcaaaatgacacaactcttctggcaaattgtttgtagtttcttaaaataaatagacatttaccaatgagtcaacaatcacatttctggacatttattccacagaaatgaaagttaatgtccacgaaaaaccccagaaagctatacacaattattgtcagcagttttatttctgagtcaaaaactggaaacaaccaaaatatctacagtaggtgaatggttaaagaaactgtgagatacccgtactgtgaactactattcagcaataaaaactgaatgaactatcgatatacacaacacctgtgatgaatctcaagggcacaatgttgaatgaaaattaaaacagtctcaaaaggttatagactatacaatgtcatttatataacactttgaccatgagagaagtataaagatttggacatagttgccagtatggtgggagaaaaaaagatgggtagaactataaaggtacagcatgaaggagaaatctgtggtgaattagttctgtattgtattgtggtggtagttacagaaatctatacgtgtaataaaaggggttaaacttatacaaacacactttatcaatgtcaatatcatatagtacaatatgatattatagttgcataagatgtaacaaatgggttaccaatgtcactagcaggatagggaaacaatacttctctgtagtgtctttacaactgtctgtgtatttgtaatattttcaaaataagttataaagatttgccttttatagtgttactgtaaacccttaagttcccactaaaaagatgaaatgtagagttatagctaataagccagcaaaggaaatagaataataaaaattttcaattattgtgaaacaagacacaaaaaagaggaaaagggaaagttgggacaaatgaaaaaccaataggttataggtttaaacctaattctgtcaatcacattaaatattaatgttctaaatatactcagttcaaaggcagagattgtcagacttaataaaaataagatcaaattataggctgtgttataagaagcacattttaaatataaagacacaaatatgttgataaggatgaatggtagtgcacacctgtagtcccagcactttgggaggccaaggcaggaggatgccttgagcccaggagtttgagaccaacctgagcaacatgacaagaccccaactgtacaaaaaatttaaaaattgaagtgagcatggtggtgcatgtctgtagtcccagctacgtgggaggctgaggtgtcagtatcacttgagcctgggaggctgaggctgcactgggctgtcatcacaccactgtattccagcctgcactccactgcactcagggcaaagcaacaccctgtctcaaaaggaaagaaggaagaaaaataaataaataaataaatgttcattattttttctcatgtgttttgactatttaaaaaatcatgttcatttatttctgattatttgtaacacattttcctatacattaattaaggatattaaccattcatctatgatatatacagtaaatgattttccagtttttcatttgtggtttaattttgtcaatgttatcttttcaatatataaagcaagtggtgtgttcgcatgtttaaataaagtgtatttctttcctttaaaaagtaataaagatacagaatgtgatcactaatctaaagaatactgaagtaactatactgatatcacacaaatagattctagagaaaaatacatcagggataaagaaggtaatttcacaatggaaaaggtgacttaatcaagaagacattaaatatttatgcacctcaactttaaaatacatgaaacaaaactgttggaactggaaggagaaatagccaaatatttcagtgctagtctctcaataactgacagaataaatagctagaaaattattaaatatatagatttgaatagtagtattaattaatttgccttaattaatgactgtagaaccctctatcctaaaatagcaggatacatattgttttcaagtacataaggaaatgttttcaagaaaagagctattctgggctgaactattttttttaatcaataaatttaagagaattgaagttatttctccaatcgcagtggaatcaaactagaaataaatgacagaaatataaaatgaaaatctccaaacacttggagaataagccacactttaataaataacctgtggatcgaagagaaaatctaaatggaagtcaaaataaacagtgacctgaacaaaaatatacataagacatatcagattttgcgtagtgttattaaacaatgcttgaagagaaattcatagcattaaatacccatattaggatagtgaaaaatggtcttaaatcacttactttatcttctgccttagaaaaatagaaaaagaaggtgaactaaattaagtagaagataggaaataaagatcagggttgaaatcaataaaacaggtagtaggccaaaaatggaggaaatctttgaaaccaaaagctggtgttttgagaaaattagtaaaatcaatacacttttagccaggcttagtaaagttaaggagaagatacaaattaccaatatcagtatagaaagaggaggcatcactacagactctataggtattaaaagaaaaataagatcatattatgaacaaccttattttatgatattaagatttaagggtgaaatgggtaaattccttgaaagagatctaagaaagctcactaaagaagaaatagatcatctgaatttcctgatatatatcaaataaattaaatctggagttgaaaatcttccctctaagaaaattccaagcccagatgactttgttaataaactttacaaaacatttctttcagaaaatggaaaaggaagttacatttcccaatccattctatgaggcaacgattactgtaataccaaaaccaggaaaaaattcacaagaaaaaacccccgaaaccacagactagtcttcctcatgaatacctatgtgaaaattctaaaacaacaagcaaatgaaatctattgacacatgaaaaggatactatatcaagaatgagcagattttgttttaggattgaaaagatgccttaacatttgaaaatcaatttatgaaatacaccatattaacaacaaaatgtgaactaacacaattattttaatagatgcagaaaaggcatttgacaaaatccaaaatggattctagttttttaaaaagctcagcaagaatagaagataaattggtcaatatgataaaaggcatctatggaaaatgtatagctaatatcatgcttaatgaggaaatactggtgttgcccccaagattgggaacaaagcaaggatttatgctttcaccacttccctttcgcagtattttagccagtgataatgagcaagaaaaggaggtaaaaggcatctgtttagagaagaaaaaaactgtctttattcataggcagcgtgatcatctgtgcataaaattttatgctctctaaaacagaaagtcactggaacttagaaatgaatttatcaagttgcaggatgcagtatcaatatatgtaattcaattatatttttatatattacacaaattggaaattaaagcttaaaaatatcatttgcaatagcattttgaacagtgaaatacttagaggaacaaatctgatggaagatatgccagtcctatacccttaaaactacagaatagctgagaggagttgaaagagacttaaatatgtgagcatacaggccaatatcgtgtgtaggttgagagacttatcttagtctcccctaattgatctgtagattcaacacaatgccaatcaaaccccagcaggcctttttttcaataaaaactcccaaacatattctaaaattcatatagaagtggaagtcaacttgaatggccaaaatatctttgaaaaaaacaatttgggaagatgaatactgtatgatttgcagacttaatggaaagctacaataatcaagaaagtggtgcgctgggcatggtggctcacacctgtaatctcagcactatgggaagactagacagttggatcacttgagcccaggtgttcaagaccagtctatgcaacatggcaaagcctcatctcaacaaaaaatacaaaaaattgccgggcatgatggcacatgtctgcagtccctagctacctgggaggctgaactggggggatcacctgaacctgggaagttgaggctgcagtgacctgtgattgtgccactgcacttcagcctgagtgacgagtgagacacaggtgtcagggaaaaaaaaaaagtgttgtcttattaatccttaactattattaattaattgaaagtttacatagggcagaaaagtgaaatattgatacatataatcaatacttatatatttataagccaaagtttgctagtgatcccaagtctgttataggaatgtgagattttattaagcataacaactcaaatgttgatgtccagttcatagaaactccatctcctagcagtcttctcagtattttgggagacttcagcaggtgtctcacttgggctcaaactaaaatctcatctctcctgtggagctatactactgtgcagatatcccctcaccacagattattgaggtgttagcctacagaagtcctagcagacctctgcagaacccctcacggtaccatagcaggtccctataccatgccaaatgggagatccttaaattatcttactggtcggccaggcgcagtggctcacgcctataatcccaacactttgggagactgagacggtcagatcacaaggtcaggagttcgagaccagcctgactcacatggtgaaaaccccgtctctactaaaaatatacaaattagcctggcatggtggtgtgtttgaaatcccagctactcaagaggctgaggcaggacaattgcttgaacctaggaggtagagattgtagtgagccaagatggccccattgccctccagactgggcgacagagtgagactcagtctcaaaaagaaaaaaaaaatctatcagtcagtcagtcagttagtctgtctgtctgtctgtctgtctgtctgtttatctatctgtctatctgtcttactggtttacttgttgtcacctgggatatgtaagaagcctgttggggcagtattcacataatctctgttaaaagtgatatttttagtatcttctatgggtcttctctttaaacatctcagatattgtctcttgtataaaaagtaaaagttgctatcccacaccacccctactatgtccttctgattgctgccttttttgcaaaagcagaaatatgtcttctgggcaccatccgcttcatggacagcaacttgtgcaaagagattcctgggagttgtcaatctacatgctcatagatgtctgaattgtgacatatcctcagtccctacccgccatccagagtcatttttctgacataaaactttcataggcaatccataccttatggcttcaccattgtaaaactggtggaaagcacaacacgctatcaacttcagcatcatgaggattggcctttgttttctaaatcctttctcttttgaaatgcacctattatacaagacttaggttgtatgatttgaaggattgttcaccagtagtgacaccgttatttattgaaccattttcctgatactttttttgtgttaactgaacttgtatatgtaattattatctggtaggatcattttttttcctagcgttatttatggcatgatttactagcatctcgttaggcaataaatgcatatttaattggatatccttatgggttcagtaccatgctgtgcataaattccagaagtatacagacccagccttcttttctctttctctctctctctctctacacacacacacgcaaatacatacacacacatatatacgtacacatacacatataactatatacatatgtatgtatgtatgagcacaaattatttggggtgggcactgtggctcacacctataatcccaacactttggaaggccgaggcaggaggattgcataagcccaggagttcaagaccagcctgggcaacataacaagatcccgtctctccaaaaaataaagataaaaaattagctggccatgatggcatgcatttgtagtcccagcttgggaggctgaagtggatctcttgagcccagaagttcgaggctgttgtgagttataattacaccactgcactccagcctgagcaacaaggcaagatcctgtctcaaacaaaacacctaattatttggagtatatagaatttgaacttgttatgcatgtatgaacagaagttatttggagtatatagattttgaagttggcttagatgtatgatgaattctcagaggttatgattaattatctttacctttcattctataagattttattgaataccttctagatgctagaatttcagcaatgagcaagactgataaggtctttgtctaaggaagaacatagaccccataaaattagtgttacagttctttcagaatttgtctagcaacctttctggtttttgctagaaagttctctcctaattgataaaataaaaatatttttgaaagggaagaattaaaaatcatgggattaaatgacaggaggagccaatctgggtattcataaaatgactgatatttctgtccacagttgagtgaaaagtattggaaaccaacattcactgagcaactactaggaaggccggatggcattcgagagaaaaagttatggtctcaggcagatctgagtttggatcctgctctgctgtgcattccaggcaagatcgtgttttggcaagttgtctgtcccatctgagcctgggttcctcattggtacagaaagtcagtaatgacatcaacccaattaaatgagagaacagatgcacacaggacgcattccacacagcgcctggttcaaagtaagtgctcaggacatgagtgccaccatccttcccccaaggaggcatgagatggaccctggttcttgctgttacggtcactcaggcaatttatactcataaccgtccggggaggtaggactcatgttttccccactttccagataaggatactgaggttctggggatttgaactaacctgcctttgacttcatatccagcaggcagccatgccgatttcaaagctccttctcttttcattcattgcaccgtttattgacctcatatacattcttcatctcctggagtgtctctcctaatcagtacatcaggggtaacaaatcttagtgacctcagtaaataataagcccaaagaattgcagtgcacagattcttgcttaagaataacagcgacttggaaagtttttcagtgttaacagagcagccttatgattaaaatcactgaagaatgcgatgtaaaatgtttttatttcgttttgctttctgtttcccttgaaataatagtcagcaggaaacacatttctgaaagacttctccatttctacatcctcagaatacaataagggccaagctgactgtgtcagggtgttcagagttagtaggcacacaaatgaaaagatggtgctctcagagttttatgaatttttctgtctagcagtcttgggttggaaagtcatctttgaaattgatgtagctatcaactaggggctaacattaagatttcagtcgaggtgtatagggttatgatctttctgttactgtcagaactgcagctgttgtatttgcattgagtggcatgctggagagagcaaaatgggatgcaggagaaggaaaaagaaatagcaaaacctattgaattgtgggctctacctgagggcatttgttaaaggtaaattcatcaatagctgttaagtcatttgtattgaatcattctcatagcctcacagcagttcttagttttaataatgggtcatagagaggagcttggtgatagatgccttattatggtatttaggcacttaattgcaactgggcttaaaatagcagcagaagctgaaaccagggtggctcaggagtaaattatgttttcagtctaccaaaacaccctttttaaaattcaagtttaatatttcttgacatatgtttcttgatacgctgttaacagcagtttatcagagatagaagaatgttaaaataaactggtgaccgaactatggtatctaaaggcatgccttgttcatcaccatcagagatattttgaaagaaacattgagacccaagtttaaaacacctgcaattatgctgggacaggggtgttcattgattcattcattcatgcattcattcattattcgtcatttattgctaatgttaaagggatagggcagtgtatgagacagacccttgcctttgtggactaattattcagtggtggaagtgagaaaaacataaatagttaataacaataaacgccaaagggggatgtgtgtgatgatgaaaccaggaagctgaaatagtgagtgatggtagaagatacagtagtgttttcttcagattagtgggctagggaagtgctcttggagaagaacccatttaagcagaggtctgagtgatatgaaggtgccaactggccaaaaagaggaaggatcattagaaacagaaacagcatgttcaagggccctgatgtgggaaagaactaaaaggagatcagggtggcaaagcttagcagagaagtcagtggaggggtaggacataggtttgaatagcagataaaggccaggtcctgtgtggccttttcatttactttacattttattcgaaatacaatgggaaacaatgaagagttttaaggacaagggtattgagctctgatgtatattattaggagattgtttttattgactctagaatggatggggagtaggtggctaaggaggaagttggcagtggtacgggagagaaatgacagtgccctctaccagaaaaatgaatggactgaaaatgtacttagaatgcatgctagtagataaagaggaactagctaggaagttccctaaaggagggtggtctgtattcttggggcatttgtaccctgatgactgaacatcctgacttcctatgtcttagtccatgtacagcaactctttgcctcacttgtaggtgaaatgattttggagtcactagttggataaagaactagaaaggtagaacatacagtgcttcctctgcacatctgatttgggagttttgaagtttacttgtcttagactgcatgaaatgtcaaaggaagccagtaacattgatttatttcttgagtccgttggttatcatcagcttgctgcttacagtatacaagcagatagagccagaagcggcatttccaggaattgaacctgcgttgtttactgcccctgtggtcttatgaagaatgtgtgattatcgtaacccacttgctattattttcataacaaagctgtctctgaccagctacaatcttggacttacataattgaattttagatggagatgcgctgctggtttatatgaattttccaggggtgccagcgtgagtccaggctttaacaaacaatatttttaattgagattttatgtccttgccctcaaatcaagcactttaataggatcccagttggaataggtgactcagtaacaagttaccactgctttcaacttcagaaaggtgttaatttctctaactcctgctgggcgtccatctactccggtgacccactgcctgcatgtaccataaaaacgagtgttttgcattccattagtttcaaagtacagccttagtagtctgcatatttcttgtagcatgtgctggctttgttccatcaggcaacattaagatagaaaagtattaaaaatattgatttgtcatttataacatcgaagtgatagattgaaatgcaatttggatgtactccagacctccaataactttgacattatcagacgaaatacaatgatctcagtctaattaatatgctgtgtccatatgagtaaagtagagagaatgaagcaagaaattggccacaaggaagtgatagctccatgtttcaagtagttgtagaatttagagatggaatatgacatgctctgtcgctggaccttgctatgtgctggaagctgtgttctttccatgtttgttcatctttgaaagcaagttagcgcattcctaaagaatagagtgatactcttcactgaactttgtaaacttctttaagctttttattatggcatcttgccataatgttcttccattcccctgctctggaataccggtaataactctaacacacacacctttctgcgtatcggtttcatgcaacaggtgcacctatcttgatttcaaaactttcctatccccctttcccttactgcttcttcacttccatcctttcctgctggtaatgaaattgtcaaactttattcctactcctatttttttttttttagcagggttctgtgttctctgtcagcctctctgctcacatattgcagttcctctgttctcccagagaatttttatcttcctgttggcaatatgtttatacggtgtgaatatgtaataattgtacttggttgctatggagaagggaaaaatacaaatgtgcaaatttcaaatacacaattgtgcaaatttcaaaatttattgtaactttttcatagtggtcatatagtattattaggaagtaatggcataaaaaaatacaaatattgaacttgagtaaacatcatgtatactgaaacttgtagggggtattttaatgatgtgtgaaatttactttgaaatgcaccaaaaataagatgggttgatggttgcagagagggatggacagatggaaatagctgggataaagcaagtatagtaaaatgccagtagtagaatataggtggtagatatatggatgtttgctgtaaaattctttcagctttgctgttttgagatttgcatactgcagtattggaaaaatatggtacaaaagtgaatagtcatatagtcaacacatagactgagataaaaattgtgtgcctgcattaatatctattcttttatttagggatgctttcaggaccgtagttgcaggaagatcatcttgctataacccagtgtccccctttcatctcctataccatgtctctctgcctgttttcttcttctctttgaatatttgttacatctgtcttaatagagactgtgcaatttcatctcttcatcaactcctgtaagtagaaccagcaacagagcgaaagggagaaaaagaaacgtacttctcgcctgccttccttttctgtctccccgtgagaagcctcgtgccctcctcctgtcttgtgtcttgtgtcagagttagcggagcagcagctctggcctccttggatttatgtgattcgtagtgagagaatgctgccacagctgaggctgttgcctgctctacattgattgagtttcctgggcttgagggatttttgccgagctgagttttatggttgatgtgctctcggtcatttgtcataaaatcattcccaccaagctgtttactgggtttgaatgcttaattactgaaggagaagagaatcactccttatggagctgactgttgacttggatgctttttactgggttgtcttctggtacccaactcttgctgagtagtttatccaatatacatacccactcttcagcataaaaaaataaagacacccataattttacctaagtattttgagcagtgcaaagacatatcatttcacttcatattatgacagcatttttcttttgagtacaaattgattgcaaaactcaacactcaggcagctacagctaggaaagtgtctatgctctggggttcaaatgacaatgttcacctgctttattcagatcaatttccagaaatgcattgctgactctccgccaactcaatatcctcaatccaaattgcataaatggtgttggatataattatctctctgaaaaatttcacctaaattggaattaaatttatttgtaaaagcaaagtcatcttgggaattatatttcaaaacctacggtcgaagattcagtgaatgaagctctttccttttgtttcttccacaatttcagctcctctttttcatgaggaaaattgaagcactcttcgggttcccactgctccctcctctgcactaattcccacatagaatttctctctacaaattggcctccactaattttttgcattggttgtgtcttgttgaatttttcaggagcacacttttatatacggggatgttgttttagaggtgggagaaagagagaattagagagagatgcaggaaatggaatgttgttttttttttattattatagtttaagttttagggtacatgtgcacaatgtgcaggttagttacatatgtatacatgtgccatgctggtgtgctccacccattaactcgtcatttagcattaggtatatctcctaaagctatccctcccctctccccccaccccacaacagtccccagagtgtgatgttccccttgctgtgtccatgtgttctcattgttcagttcccacctatgactgagaatatgcggtgtttggttttttgttcttgggatagtttactgagaatgatgatttccaatttcatccatgtccctacaaagggcatgaactcatcattttttatggctgcatagtattccatggtgtatatgttgcacattttcttaatccagtctatcattgttggacatttgggttggttccaagtctttgctattggggatagtgccgcaataaacatacgtgtgcatgtgtctttatagcagcatgatttatagtcctttgggtgtatacccagtaatgggatggctgggtcaaatggtatttctagttagatccctgagtaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtctcctgttttaatgccaagataacccgtcagaacacctgaaatatttgctacagttttgatgtttcatttatctcttagtggagcattgtgttgtttcagtgttttatcatgaagaactgtggctcttttaactgtaaggaatgagaactttagtaaaaacaacttttaatcactttgctataaatataatactagagaattcgtttcttggagtatgatttccctgttattcaaaaacaactacttgtcacccccttgtactttggccttcttttttcttctccccttcttttaactgttgcccctatttggagcgattatacttaaagtaatatggattctttcagagctgccaaaaggtgaaattgactttttgagaatgtattgctgaaaactgcagcagatgcactttttccatgtagaaacatcctgtgtgttaagaccgaaagggaccatttacagccagtttcaaattgctagctgaggtcaataagtgcccacttctgcaatcacatcagccccgtttggatgacagtacacaatgaggtgcctcccagggagtgaccacattggcagcaaaaccctttttgcaagttttatttggtcattcatagtagaaacctttaaaaatcttcaacatttaatttcaagcatttaaaaaatatatactgtagtaccatttacctataactggatttatttaaaaattatatggattggggaaaggacaccctcttcaataagtagtgctgggaaaaaaatggatatccgtatgtagaagagtgaaacaagaccctatttcttaccgtatacaaaaatcaactcaaaatgcattaaagattgaaacccaatactataaaactactagaagtaaacataggtaaaatgcattaagacactggcctaggcaaagattttatggctaagacttcaaaggcataggcaacagaaacaaaatatacaaataggactatattagactaaacagctttggcacaacaaaggaaacaatgaatgcagcaaagagaggatctgtagaatgggagcaaatatttgcaagctattcagtcaactcatatccagaatatatgacaaggaacacagtcaactccatagcaataataataataataatcccatttaaaaatgggcaaaggatctgaataaacatttcttaaaagaagatatacaggccgggcctggtggttcacgcctgtaatcccaacactttgggaggctgaggcaggggggtcatgtgaggtcaggagttcgagaccagcctggccaacatggtgaaactccatctctactaaaaatacaacaaaaattagccaggcgtggtggcagacacctgtagtcacagctccttgggaggctgaggcaggagaattgcttgaaccgaggggatggaggttgcagtgagctgagatcgtgccattgcactccagcctgggcaccaagggcgaaactccatctcaaacaaacagacaaacaaacaaacaaacaaacaaacaaaaaacatacaaatggccaacaggtataaaaaaaatgcttattatcactaattatgagggaaatgcagatcaaaacctcaatgacgtataatttcatcccaattagaacgactattatcaaaaagataaaaaataaatgctagcaaggatgtggagaaaagggaacttttatgcactgttggttggaatgaaaattggcacagctaatagggaaaacaatacagaggtttctcaaaaagactaaaaatagaactaccataaaatccagcaaaatcccactgtggatatttacccagaggaaagaaaatcaatatctgaaaggacctgcacacccgtgtttactgcagcattatttacaatagcaaagatataaaatcaacctaagtatccattaagagacgattagattaaaaatgtggtatatatgcacaacagaatactattcagccctgaaaaaggatgaaatgctgtttgttacagcaacatggatggaactggagggaggtcattatgttaactgaaataagctgagcacagaaagacaaatatgacatgttctcattcatatgtgggagctaaaaaagttgatctctggaggatagagagtagaatggtggttaccagaggctgggaagggtagagaaggtgggatgaggggaggctgattaataagtacaaacatatggttagataggagtgagttctagtgttccacagcatagtatggtgatgatggttaaaaacaatttattgtacatttcaaagtaactagaagaaaagatttgaaatgtctccaaccatagaaatgacaaatgtttgaggtgatggatacccccaattaccctgatcataacacattgtgtgcatgtatcaaaatgtcacatgtaccctgtaaatatgtacaattattatgcattagtaaaaaaagattttaaacaattacaacaacatccaggttttgttggttgtttttaatgcggcagaccctgtcctctattacattgaactgtcacacttttaagaagtcagtccaaactactatcttctttataccaataagaaggatcaggacacagaaagttaagtaaatggtccaagtcagtaaatggggattcatgattttgaaactttgtggtcagacttcaggtactgtcctcttaatgtcttgctgtgagatttgagatccaagataacttggcattgttgagatattgggaagctactatcagaatcagtcctctgcttgctttgttggtgtaaactagagataatttagtgtaaaatgtcccaataaaaattttcccccaagcatatgtaaaccacgacataatagatttatcaaagtagcagaatgctattatgttcaagagattaaccagaccaaagctatttgtcatagcaacgggtgctagagttgacaaattacaattgaacccagtttgtagcaaaatgttagacagagccttggcactgattaattgacgtgagagtccagcctagaatacattagagcaatttaaatatcattcaaaacagaatataaccatgctctctaaaacatcccaaactgtaccaagcaactacatttgattgattctataatgcaaatattttatgcctaagacttttaaagcacagactgtgttagtagcaagacacaccaccaatttagtaatttctaattaaaaagaaaatacattttacattaaatgcttatattgattgccaaggaacctgactacaggtcttttaaaacttgcatcatggggttgagagggacaatcatctcttagaaatttcttaaaaagaaactttaactctgggtaatgtgtttaccctaattagataagaaacctcatcctaataaaagtaatggactgaaggtgacatgtgttcagggagtcgggggggaaagagtttagaaagaggaaaagcctttgctttctaagctagaaaaatggatgttgaacttaaatctattcagacaatgatgagctagtcatattgtcacaagaataggttacctctttcttgcatttaaggttcccgttatgaaacagaaaacaagattatattctactgaaaataaagttgaaatggagtagaaaaagtggagtttcatattacttatcaattcttttttttttttcttttgtgagacagagtctcgctctgttgcccaggctggagtgcagtggcataaccttagctcactggaacctccacctcctgggttccagcagttctcctgtttcagcctcccaagtagctgggattacaggtgcatggcaccacagctggctaatttttgtatttttagtagagacagtgtttagtcgtgttggccaggctggtcttgaactcctgacctcaggtgatctgcctgcctcagcctcccatagtgctgggacccaattaattctttagtcaaccaacttcatttcttgatatgtcagttgtctgtgtgtgtgtgtgtgtgtgtgtgtgtgtgtgtgtgtgtgtgtgtgtgtattttcagtttttgtccatctgacagttgctgttgttttcattgttaggatatgagttccagttccagtatttctgtggcagagccttttgttctttagcatgtagggatttatttaggtctattacttgttttcactttctctttgccttttcttaaatttcaactttaataatagcctttaatagaataacagtgcattagctttcattgactacatgtatgctgaagaattcatgctaaagaaataataaggaatgtgtgccaagatgtggctatgaggatgtttattactagattgtttataatagcaagacagtggaaaattacccaaatggcctataacagcgaactgatgaaatcaagtatggtataaggctacagtggaattctcattagtttattaatcatttatcaaatattagttgagaggatattttgtatcagcccttgtggagtctctgaatatgtagccttcaagggcattaatagtgaaatggtggaagaatcgtcaatggcacagcaaaaggtgagcatatggctcggggagtccaaactcagtgtgatcttgttttcattaaaagataaaaggaaggtagaaatatgttttcttaagaaaaaaaaatgtacgtacacaaagataagcatcgctatgtttgactccttggatatttattctctaaatagtttgtaatgaattcctcatgtctttaagcaggaaacaaattgcaaatggtttaaaaaggcaattgctttaaaggattgaggagagcattggcacctatgtttctgttatctatgaaggtggaaggggaatcaagatggtttcagtcttttgtttttaaagcaaatggaattcttcaacatcttaactatcttttaactcttgctcttacaagaagtgatactttaatgtttaagaaaggcatgtattattaagaaaaaataagataaaataccaaggataccagcaatcacagcggactgagtggtatgtgaaaagataaacagtaaatgcttttggaaggaattgttagtcttctcgacagtttagcatttgatcttgttttgcgttggtagactgacttgaagtactagactgaattgggtgagacaaataaaagcatatactggagcagagagatccaatctttccctttctctgcaaggtttgtatttaggttataaaaataagtgtaggagggaagattagggcaaggcacagccttggtgcaagatgcagagatgagcagtcacgtatttcacacagagtaggatcagagattccaactagaaccaacaccaacagtgtgtggccccagggagtggcgctgcctctggtcaatgccacccaccagaattggactctaatggatagatcttcctagcactgcgtctggtcaatgccacccatcaggatcggactgtaatggagagatcttcttagctctctccctaaaagttgactgagccatctttccaattaataagaaaataccaaacagaacattaaagtttatagcttcacatttttgaattaaattacctattgattagtagggggctatcattaaaaattagcacaatcacgactgacaatgccttagaaattttcatcatgatgactttgatcaaattgtaaatgtgaatctgtactttattttagaactaaaggaggcaaatgagcaataaatttgaagcccaggtaattgggggaaaaagtaatcaatttaatccgtccgaagggctaagtgattcagagaactgacacttggatatttggttgaagccttttgtctgaaaatgtcacttgtatatgtttaagaaaatattctataccagacatacatttagtctttgcatctcttatgttgttagttttcagtttttaagcataaactcaaggtaacagttttcctgttagtttttagtttttaaacatacactccaggtaatagttttcctttctcccaatctcctttttttttttttttttttttttttgagacagagtcttgctctgtcacccaggctggagtgcagtggtgcgatctcggttcactgtaacctctgcctcccagattcaagcagttctctgcctcagcctcccaagtggctgggattacaggtgctcgccaccatgcctggctaatatttgtatttttagtagagacgaggtttcacgaacttggccaggctggtcttgaattcctgaccttgtgatccacctgcctcggccccctaaagtgctgggattacaggcatgagccaccacgcctggccctctctctccttgttgctactacgccatccagactccagtcactcaaagcaactacatctctcattccaagcaggtaccttcttcctcactctaatcccacattgtcttcacctctagactgatgatcatttatctctgacattttttgttcaaccacagcccacttatgcctgccttctcacgtgccgctcaagctcgacaactctacaggtgctaagatgaaatatagtgtagatgttaaaaggatttctctggagcctgatctccacatgtggttctatcttctgctagttgagttaccttgggaaattagcttagttttctgctacctctgtcttctcctctgtaaaatgtagtaacagtaacataaaaattccatagggttataattagaattagataaaataactaaataattgcaaataatctattatgtagagagtgataggttatatatgtagtgtctagagtgcagacttctagtgaaaatactgacttttggtcttcagtaaactagtaatatgtcaatgttggctttttcaaagtaatttttagcaacccttactagtgcacttagaaggtaaatattagcaaacagtacttaattgaacataccaccaccgacaatgaaattatggattacctacctgtaagaacaaaagaaaaggtgtgaatttttggattagtttatggctcaccagtgttacccctttacaaggtatacgcccacggtcgttatgttcaaaggttgaaactctagactactatatttaattctcctcaagaatcttagatatgaaaggaacagcaaaagtcattttatcaaaatttagtcctggtagaagaactccattaaacttggcatttggttatttgttttgggccccagtgatttgctaaagaataggttgagttctagagatagaaaaatagtaaggtaaagagccttaccccaaggggatagggggtagtcaggaagacaggcaaggaaacaggcaattgcaaaataaaaaccaggtgttaccagagtcatagtggctctcaaaggaggtacctctccttgccttgggtgggagtaagtgggtacaaagagaatttcagagaaaggtagcatctgagctgaaacctgaagaacaagtaggagttccccaaatgaagatagaggaatacagcaaagaaatttgcccagtgcaaataggaacatgcaagatagagaatgtgacgttcattcatggctgtttattattaaggtcctacaatatatcaggactgtattacgagaacttatgtaaatgtcagaccactgtctcctccacctctaaaatgagttttttcagggcagaaactgcccaatttatctttgctaacctaatgccttcagctcaatgtttatcaagtggaagatgttcaataattatttgttgaaggaatgaattaatcaataaatggtttatcacaatttcctcctgttagtgagaagcaaagtcattggaaaaaccatttaccagtatagggtcaggctagacacttgtaagcccatcaccagtgattactttcctgttggagagccatccattccatcagtattgtttggcacaaccattcaaccagcaaactgtatcttcatgggcctgtacacctgtcttattcatggatatttcacaagcgtaatggcagatgtgtgatttctgacctctcctccaacctggttgacttgggttatagcaacagagaaaatgagttttgcttggggttatttcttaataagctatcattgaccattaatcatcaacaaccacttgcctttccagtgtctcaccaattacgtatttcattctctgttctacctcccagcaaagtatcgggtctgttttaggatttacgtttttattagaatgtttgccccttttagcctgatagcacgtttatcattccaaaaccactggacggattccacacaaacattaaatgtttaaatgtgttcacactgaaacgtgtgggaatagcaaatggtcttttgttgtaacttttgaagatcttctgtaattcctctatttcatttgcatattgaagtgcttgcttatgttcaggaacctgtgcttagcgtttgtatatgtcctatggttcccaatattaatgagtcctggagaaagttgaatctgcaagtttctttacagtggccatcagggaatgaggtagcaggatgttaatgctgtctgcatgctgtgaaggatgataaactgtacttgggtgaccttattaatcactcataacgtgatcttaaaggtatgtgcattttctgtgcctcccagtctttgcgtatggagagggaaagatgggcattccctagtccccttaagctctaggtgccctcaatatctcccacttgagcatctgaacttcatctcagttttatgacagcagctggcatgcaaattggctggacttgaaagcactgaagttcacctcactttgctcaatctgtgcacaaatgatcaagctcagcaattttgaaaatggcccacccttttaaagggaaaacctgaaatattttcagtccttatggtagtcgggccaagcagtgtctggtagcccattcttagttctgttaccagcaggtaatgcaggttagcttgatgagcacaactctttgtcttctctccacctgtctctgtccattcattcatcccacggatgcttattgaatgtccactcaatgttggagcaacaacaggaaataaggacatggtttctgtccccatgggacttacattctacttggatatactagggagaaaaaagagtaaacaaaacaattagagatgataattattaagagtaaatgcatgggctgggtgcagtggctcacgcctgtaatcccagcacttttggaggctgaggcgggtaggtcacttgaggtcaggtgtacgagaccaacctggccaacatggtgaaaccctgtctctaccaaaaatataaaaattagctaggcatggtgacgggtgcctgtaatcctagctactcgggaagctgaggcaggagaatctcttgaacccagaaggtgaaggttgcagtgagccgagattgtgccactgcactccaacctggatgacagagcaagactgtttcagaaaaagaaagaaataaaaaagaaaagagtaaattaatgggatattgtaatggagaatcataatgtgtgtgttggctaaggttttcagaaaaaaaaaaattcatggtgacatgaaatttaagcagaaatctaaagtcctaaagaatgcgagggaatctggggaagcgtgctctaggctgatggaacagcaagtaaaacgacagggaatctgtgaacagtttaccttgcatgaggctctgaatgcagcacgtggtaagggagggggtggactaaaggctggaggaacagaatgaggccagaacacacaggctcctgcaggccaagatctgggtttgattgcaaacacaatatatagctcaagtttactttgtactcaacaaaatccattctgtctaccactggaaataatagcaaatacggcttgttggaaagtccgtgtgtaacttatctcttattattgctgagaggatcaggaaaaataactgttgagtattagactgaatacctgggcaatgaaataatctgtggaacatacccctataactcaagtttatataacaaacctgcacatgtacacctcaacttaaagtttaagaaaaaaagaatgctggtgggaatgtaaatgagtacaacctctatggaaaacagtacagagatttttcaaagaagtaaaagtaggtctaccattcggtacagcaatcactctacccaatactgggtctctacccagaggaaagatgcctgcttgcatatatttatcataacacaattcacaattgcaaagatacagaatcagccttagtgcccagcaaccaataagtagataaggaaaatatggtatattcaccttgaaatactactcagccataaaaaagaatgaaataatgtcttttgcagcaacttggatgaaactggaggtttcttctaagtgaagtaactctgaaatcaaaaagcaaatactgcatttcttcacttgtaagtgggaactaaggtatgaggatgcaaaggtatacagtatgatggacattggagactcagaagatgggagggtagaagggggatgaggagcaaaaaactacctatttagtacaacgtacactactcgggtggcaggtgcactaaaatcctagatttcaacactatgcaattcatccatgtaaccaaaactaacctgtaaccctaaagctattgaaatttttcaaaaaatatttaaaaagaaaaaaaagcaaaattttagatatggagaaaaaaaaagacatgaataagagcccttcagtccaaccagaatttgatttcactttcctctccttgtcattgtttttatacagctctttatctctttccaacagaaaaagtaaagaatttttccttttttatttagttttttaatgttcagagtggaaaagacataacttttcctacttgagcatttgtctgttttttcattgtaaatattattattgtccctgtagcctgggaggcctttcaaaggtcacttggccttttctagtacagtcacatgcccttcttcatttttaaatctttgagggggagaggggaatgagaaaatattccggaatagcactgtccaatagaactttctgcaatgacacccatgttctttatcatcagtgtctaatgaggtacctactagtcacatgggacttgtgagcactcacagtcaagctagtgctaccaaggagctgaattttaaattctatctaattagccacatgtggccaacagctgtcatcttggacaacacaactctagagcctcttctgaatgttatgccagtgaattcactgaaattcacaactggaatttacaccagtgatggtcttcatatgggcttccgttagtgactttggtgaagtttcaggcgagacctaaaggatgggaggggatctggggaagcatgttctaagctgatggaacagcaagtaaaaagatactcagtctgaggacacttgacctggcatgaagctctgaatgcagcccgtggtactagcccttggtaagtcgggggaggctgaaggctgaaggaacaaccttccagctcaattccaggtcatttctggtcatggcgaggtctttttcacaaaataatcattgttttcatctattcagtatccatttcctcatcctgtggtcctataattgcatttttcttaggggaccacctctcttgcatttttcctccatacttccagagagctggctccttaccgagctctagagttgggtatggaacctaaacctagccagctggcataactccaattcccagccacagggactggctcctagatgaccaagtggctcaagtctctccaaggagactcagtctcagaacacttgttaaagctgttagagactgaacacattgagcctgaaattgatggccatttctctgcccccctgagaatgtggccaacctcctagaaagaccacagggctaggactgagttccaattctctgaatgtagccctgctgcaatctataattatcctgaggtttttcacttatgtgaacgaatacatttctttttttgcttaagccaatttgagccagtgttttaatttaaaacctcacccccaaaaaaattctgatgaatacaataatgtcaaatatagcatttgtgacagtataaatctttcaaatcccaaagaactcatccctaagaaattatggagaggctaggtgtggtggcttatgcctgtaatcccaacactttgggaggccaaggtgggcagatcacgagatcaggagttcgagagcagcctggccaatatggtgaaaccccatctctactaaaaatacaaaaattagccaggcatggtgacgggtgcctgtaatcccagctactcaggaggctcaggcaggagaatcgcttgaacccgggaggtggaggttgcagtgagccgagatcgcgccattgcactccagcctgggcaacagagtaaggactctatctcaataataataataataataataataataataataagaagaagaagaagaagaagaagaagaagaagaagaagaaattatggagaaaactggacaaaactgggagtacagaagtggaaaatcacattgtgaaggagctagtgaattttctcccttagttatttagctggaaatatgaatccactgataaaggtggatttgcttggcccccgaggcagaggttgcagtgagcagagattgtaacactgcacttcagcctgggcaatagagctagactccatctcaaaaaacaaaacaagaccgaaaacaaaagaaacaaggacctcactttttactccatatacttttttttcctgtttttgcttttttaaacaataaatgtttgtaatttatatgacaataaagagtcttattaaaaagtatttcaaaaattttttttcttctagggtagatggtgtagttttcttattctttgaaaatacaaatataattgctccaagcaaatcaaacatataagagtgcagagagagagggaaaattcccccccagcccacacaagccttctaaatgtacttcccttcccagagaaaactactatgaatagtatctattttctatacattgacaaaaatatttagagatagtgggtatgtatgagagaaaaagatggatcaataaatacacatctacaaacatatatgatttggtttaaatatcgcctacctgtatatattcattagtatgcgtatgtacaggcatatatatgtaaaatatatatgtacctatatatatatatgtatatatgatattatgatgatattatttttctttttttttttttgagacttgctttgtcgccaggttggagtgcaatggggcgaactcagctcactgcaacctctgtctgcaggtttcaagcgattcttctgcctcagcctcccgagtagctgggactataggcacccaccgtcatgctcggctaatttttgtatttttaggagagatggggtttcaccatgttggccaggctggtctcaaactcctgacctcgtgatctgcctgcctcgggctcccaaagtgttgaggttactggcgtgagccactgcgcccagccaatattacttctttttctgtttaacagttgatattgtttggctgtgtccccacccaaatctcatcttgaattcccacgtgttgtgtgagggactgggtgggagttaattgaataatggaggcaggtcattcccacgctgttctcatgatagtgcataagcctcatgagatccgatggttttataaaggggaatttccctgcacaagttctttctttgcctgctgccatcgatgtaagatgagacttgctcctccttgccttccaccatgactgtgtggcctccatagccatgtggaactgtaagtctattaaaggtctttctcccgtaagttgcctaggcttgagtatgtctttatcagcagcatgaaaacagactaagaatacagcagtacatcaggaatattttccatgagctacatctccactgcaacattctttttagcaacagtgcagcattctgtagtttgtatgtatatccttaatggtttatcacccgccttttaataaacatcaggctgtttcctgtttttgcctattcgtgacaatgctgaaacagcttcattgcgcataagcaagacttctctatggcatctccaaatgatgactgttggctctaatgtataatacgagtgtatcttccatatccctctctgctaatgttccctgctgatgtaggataagcttctgtggcttgatcttggctgataatttgggtacaaatctaacaaaggcatgagatgtgttctaaacttacctctagaaaagtcagggttttttttgcagcaatgatgccacaaaacacattctgaggacaactcaccacgagtttgaagatgatttgtttggagcgatttgaaatcaaagttcagatttatttctcataagtctgttgtttagagggggatttcgtgaactgttcctatctatgtgccttatgcctgcaggctacaggtcctttatgagatggctatttttaaaggaacacctctattctcaggatggttgacaggacttttaatgaggaaagaaattagaaatcagagctggaggcaaagtggtcagcagaaaggaaagaaaaacaaggaacttgtattaagcagaaaggcagcttagtataccctttcaagtgtctgttattgtaaatattcttgtatatatccattagcagtcatgggtgagaactacagaattttttgggttatcatcataggaaagtacttaccacatctccacaggctcctcattttacttaaacttgaccaaatccagtagcaattgaaactgtacaaatcaaataatgtatttaatgcaacagggcaggggttggaaaactgcagcctgtgggccacatttactccacttggattattattatttctgtaataaagttgtattatgtatacccagctgcacctatgcaagcatatatttctgcggcagcttttgggtaccacggcagagctcaatattaggatagccctgcaagtcgaaaatattttctttctgcccctttacggaagatgttcgtcaacctagggaatctcacaatttcaaggtgttccctgttcaatttttttttttaatgtgagaaaagaaatcaatctctactcagaggctgcagagccttcctgggaggagagaagagtccacaaagttctccgtctgcctgggaggcagatgcagatgagaggaagtggcataggctgagctgtacctgctggattcattcttcttgtctccccagttgggaagttaaggaagttactctttatatgacagggaggaaatgagcaatggagagagcccatttctaaatagtagggctgaagtctcccatggataatgcaacacagttgtcagtgacacaaaatgatgtgcttgggtctgagaattacctcttatttggaggccgaattgtgtctccactacccccgattcaaatgctcaaattctcacccacaggacctcagaatgtgagtctgtttggagacaggatccttaggaagttaattcgggtttcatgaggttattaggttgggcccgaatccagtgtgtttggtgtccttataagaagaaaaaatcagaacccagacacacagagagaataccatataaacaacacagagggggaagatggtcgtctgcaagccaaggaaagaggcttcagaagaaaccaacactgcaaacaccttagtcttgaacttctaccctccagaattgtgagaaaataaatttctgttgtttaagccacacagtctacggtgctttgttacggcagccctggcaagctgacacacttctgctcaagtctatgttggtatcttcttagatatgatgcagatagtacacagatctttctgacgcctaagtcagcagccctggcaagctaatacacttctgctcctgtctgcattggtgtcttcttagatatgatccagatagcagagagactttctgatgcctaagtcagcagtcctagcaaaccctagcaagctgaagccaacacacttctgctcaagtctaccttggtgtcttctcagatatgatgcagatagtatagagagctttctgatgcctaactcagcagttctcaactgtggacaattttgctcctcaggagacatttggcaatgtcaggaggcatttttgattgtcataattagtggagcaaggcactataatgctactggcgtctagcgggtggaggccagggatgctgtttaacatctcacaatgcacaggacagccccctatgacaataagttacccagcctaaagtggcaattgtaccaagactgagagttcctgatggggcagaagatgcattactgtcaggctgtgtcttttcccttctccccattagacctttggtgttctttgaaggggccggaagaggttatctcctactctgggcattgtgtagaatagctatataagatcctcaaaataattgaaacggaaagactcccttcggctctttctgccattccagtaaattcctgctaagtatgctctaggaaaactatgaggtgctgtatgatttctgtgacaggaactgtggctttcctgaggaacagtcttcctttcaatgctgttaacttcccccaagtttgtggtctgttggtggttccggtgtgggcaaagaggaatgaatgattgatggactgtgagcctcccaagtagaagtgggctagtggggagtttttttaatatcatattttatatacaactgcaggtcaggccaggctatggatatacagtgcctgaccctagtacagaggaaggatcgattgtgctcaaacagtgagctatccaaataatttatttatgcagcaatgcagctgtctgcttctttggaggtgggcacaggctggaagggttttgtgtgtgcgcacgtgcgtgtgtgtgtgtgtgtgtatgtatgtgtgggcatggggtgcatttgtatgtgtatgtgtgggtatggggtgcgtttgtgtttgtatgtatatgggtgggtatggggcgcatttgtgagtgtatgtgtatgtgtggggtgcatttgtgtgtgtatgtatatgggtgggtatggggtgcatttgtgagtgtatgtgtatgtgtgagtgtggggtgcatttgtgtgtgtgtgtgtgtatgtggactttgagtgcatttgtgtgtgtatatgtgggtgtgggatgcatttgtatgtgtgtgattgtgtatgtgtgggtttggagtgcatttgtgtgtgtgtgcatatgttgggatgtggggtgcatttgtgtgcgtatgtgtgggcctggggtgcatttgtgtgtatgtgagtgtatgtgtgggcatgggatgcatttgtgtgtgtgtgtctgtgtgggcgtggggtgcatttgtgtgtgtgtgtaagtgtgggcttggagtacatttgtgtgtgtgtgtgtatctatatatttgggtgtggggtgcatttgtgtgcgtgtgtgtgggtgtggggtgcatatgtgtgtgtgtgtgtgattgtatttgtgggcatggggtgcatttgtattgggcttggggtgcatttgtgtgtgtatatgtatgtgtgggcgtggggtgcatttgtgcgtgtatgtgtatattggggtgtggggtgcatttgtgtttgtgtatgggtgtggggtgcatttgtgtgtgtgtgtgtgggcatggggtgcatttgtgtgtgagtgtatgtgtgggtgtggggtgcatttgtgtgtgtgtgtgggcatggggtgcatttgtgtgtgtgtaagtgtatgtgtgggtgtggggtgcatttgtgtgtttgggtatggggtgcatttctgtgcatgtgtatgtgtggatatggggtgcatttgtgtgtgtgtgtgtgggcgtggggtatatttgtgtgtatctatgtgtatgtgtgggagttgggtgcatttgtcttggggggcatagggtgcaattgtgtgtgtatgtgtgggtgtggggtatatttgtgtgtgtctatgtgtatgtgtaggagttggttgcatttgtgttggggggcatagggtgcatttgtgtgtgtatgtgtgggtgtggggtgcatttgtgtgtgtgtgtgtgtatgtgcatgtgtgggcatggggtgcatttgtgtgtgtatgtgtgggtgtggggtctatttgtgtgtgtgtgtatgtgtatgtgtatgtgtgggcatggggtgcatttgtgtgtgtgtatgtgtgggtgtggggtgcatttctgtgtgtgtgtatgtgtgggcgtggggtgcatttgtgtgtatctatgtgtatgtgtgggagtttggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 2048 - DNA, 1694210 bp, Homo sapiens; identical to SEQ ID NO: 2047

SEQ ID NO: 2049 - DNA, 939532 bp, Homo sapiens
ggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 2050 - DNA, 48025 bp, Homo sapiens
cacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcctccagcccctgggggccggcgttcctgggctccgcccccgtccccgcccctcgaccgccgctgctccgcggggactcggggagctcgaaggaactctgggaaagtttcccgctccgccccggcccgagcggaagcgcggatggggcgtggcccggtagctgtggccgcgcccccaccgattgcgcatttcgattggcgttagtggccgtccgtcagcacgccccctccggtctcgcgtcccgattggtcgcgggggccgtcagtccggctccggcggcgggcgcttcccggggctgcggcggggcggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 2051 - DNA, 47394 bp, Homo sapiens
cggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 2052 - DNA, 43211 bp, Homo sapiens
gctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 2053 - DNA, 47394 bp, Homo sapiens; identical to SEQ ID NO: 2051

SEQ ID NO: 2054 - DNA, 145323 bp, Homo sapiens
agagtattgcaacactttattaagagtattggctttgaatcagtagctgaagtaacaattgcatgaagccagattaggtgcactgcataatacccatactcgatttattgacattacttagcaatttactggacaaaagtcaaacttttttgttttttattaagcacattccacagtacaaagctgtcatgaataatatctgtacaatttaacagtttcaatagctgttcagacacaaatttatttcaaacagataattggcaaacataattaattacaagttagaattagactatcccagtgctttaaaacattaatatagcagtaatttacatttgctcagttatggttagcaaaataaagtccagagtatggctgggaattactattataatcccagaaagtcagaactccttgggtgccaaagtcccctgctataatttagtaggcacaattcaaaggttgtctgcatattcaaaggccatcatctcccaaggaacgaggggaacttctatattaaacatgcaaaaacaacaaaaaatccattcattcattcagaattgcctcctcccctgccccctcccttccccctgggctttcctaaccagtttgatattgaagctgtaggatgaaaagtggtcaaagctaaatcactttcacaaccaccatcaagcttacaacatccaccttatgaatggaggtttattgtttacactttgagactcaacctctcaaaaacataaattaatttagtaacatgggaaggaaggattttatttttaaaagaaaaactaaaaaagcaaagccaactcaataaacaaatcacatacacacacactgatccccacaccgttctcaatgcaaaggacaaatcagagcccagggccttccctttagtagtagagtgtgcttccacgggaagaggtttactttataggaggctgtttattggtcctttaaaatgttattgacattccttgatctttggaaacaatggcgaagggcaaatcaaacctaatattgaataagggagaaggagtgccaattggatgccaacgtcctttccatgcactgtcagggcaacagtgccatttacacatttgggctgtgtcgtagggaggacttgggagctttgagaacctgctggggccacagcagcagctgacaccagagatgactggggtggcattcatgggcttgaggcttcactccacttcagagcacccacccctcagcatgggcctctgaaccagcctgacctgccctgcaggctccaacacaccagcaggccctgccagaaccttggcaaggccaggatgcatgaattccagagccaagacagcccgtcaacagggccttcttatttccccttcccagggccacgactgcacagaataatgatttttgacagcgaagccaaatgaatactatgggaggtgaccacttgtactcaggagtacttatgagaaaaagaataagaacaaaaaatgtttaaggtacctctctattgtataatatatactccacaacaaataaaacattttggtgttaaaccttagaaattacattttaaaacaagattctcattaaaaacacacacaaaccacacacacgcaatgacaacaacaaaataaaaacactgtatgaatactgcaggaagggttctaggtaatccacatcaacccaggtatcaggttcttgagcccagcccatggctaagtgcgaacacactctgtattagtgtctcaagcacagggggccctgactccagcaactttgaggttaaactgttatgtacattatatctacatgcgaatacagtattttaaattaggaggcaagcacacgtataaaggtgttactctaccaaatatcaggagatggttgggggacagagaacagttaataaaagaaagagctatattacctgttggtagataatataactgacttatagttctttaaattaaaagaaattggtacagaaaggaagtataatcccaaaaatattactaaaacaatccagagaaaattttccactgtccaacatgttcctaatacaacaagtcagaattcataatgacttggacggtcaaaaggagaatgctaacttttgaaaatgaaagccctggacattctgggtaggtgtttggcacccaaaatttcactgaagaagaatgctgtttcttaatatcaaaccaaagtgcaaagcaatataaattagaggccaagtcttctcttgacggtcgatttacttctgtaaaacagattctatgttccttttctatgaacaatttacatttgaaacattagattttttcactgatgagggaaggaaacgggcttctgttctacttgaagccggggaagctaaggtctccttctcaaaggagagccggaatcagaggtgagaaatgtcggtacttgaagagttaggctgctttgcatctacccagcgtctagaaccaattccagcttcataactcagctgtgaacgaactcccttaggcatttggtagccacgtagccagtagttcaagactagaaaaccctgaggaaagaaaaacagaagcaaagggagtgtgggtgaacattccgtttagatgagaatacacacactccactccaccccctgcacacagctacatgcaaaacttattagcattaacagcagaagctgtaagttgttctgagtgtactacataccaggtatcacatttatttcaacctcacaacaatcctgtgaggaagaaactattatgacacctgcttcacaaataagagaactaaggctcagaaaggctaagtgtttggttcaaagagtcaacaagtgacagagaggggattcaaggagagggctgaccctataacctatcactctctcagtactgctctgaaaaagtacacatataacaaaagatgcttcacattcgattttatatttagcataatcttttatgacattcagaacctacaagaggccagtctcacatcctcacgagagccctcatcgatcacaaggaaacaaaaatatgcaaaaattagcctttctaaaatagaatgctagtaatcagaaattacttcctttttaataagtaaatcattggtaaaacaacaacagtatgggggaaaggccactgaatgttccataattttttgactatggctttgagtctgaaacacattttaatcacaatttctacattcatcatgtatgtaaatatgtacacacacacacaaaaaaacaatattcatgagaatactgatattcacaatatttatcatttttacatacaatgcaggctgacattttctattctaaatcaaaataaagtcaaaacccactcagatactgtcacaataagtgatgcactaaaccactggccagaaagtctaaagtcaccttaggtggcaaaaaaaaaaaaaaaagcaagagagactttttaaagcttgaatgctttttttaaaaggtgattttcccagaaagttgtcaatttacacaaagatcaagaatcttaagtcttctcaatgaatttaagattcaatttcatttgctactgttttcccattaaggatatttaagggaacctgaattatttcaaaaacattaatgccccaggaccagaagtggacactctcaaatgctgctgaggggagcataaactgactgaactcttctggagggcaaaatgacctacatacgcacatgtaccctagaacttaaagtataattaaaaaaaaaaaaaaagtcttcaaacgtgataccttttaacccagaccctccagacatttccagaatccctccaaagatgataaagggttggacaaatattaggttaaaagaatgatcatagcattgttttttataatcactaaaaactgggggttggggaggataaatatgtaacaacagagcatatccaaacaatctaatataatttggcaattaggaataatttggacaaatacattactaacatgcaagcatttcacaataaagaagaaaaacacatttgaaaatgtacagttataaagcgtcattttaaaaagcctgaaaggatctataaaaaggagttagtggtaaaccacgagcaggagtttactttcttcttttggcttatctactttttcaaatttcctaataacgatcttatattgtcttgtagtaagaaaaaacaataaattttgagctactgaatatataatacaacatacagctcttagatgttactaatttttttaaaaacgactccgcagatagatctactgctgcatttgctgacatggagagactctcacctgatattttacgggtgagtattttactgcaaggttaaatcatcattagggtagtgtttcttattatgcataaatcttatggtatcacatggctataatttttttcatgttacaataaatgaaaagcatttggggccgcacgcggtggctcactcctttattcccagcacttcaggagtctgaggcgggcagatcaattgaggtcaggagttcgagaccagcctggccaacatggtgaaaccccatctccattaaaaatacaaaaatcagctgggtgtgatggcacatgcctgtagccccagctacttgcaaggctgaggcaagaggatcacccgagcctgggaggcggaggttgcagtgagccaaaattgcaccactgcactccagcctgggtgacagagcaagacattgtctcaaagggaaaaaaaaaaaaaaattagaaaagagcagtaaaatctataaagttgactgccaaggttgttaaaagtaataaaattgaagagacaaacacatttgtggtctcactgcttgtgctgggatacagggaacctccagcttaagcagataagatttttccattgacttataattgatcacaactaggcagttgttctgaggtttccaaaaaaggtaggtaggagggagggcctggaggaagtaacacaagtttcctttctaccacagccaataagaaacagcattggtgatcactgcttcatctctcaaccaaaggaatcttgttcagggcacttttaggtaatatatagatgttgtcagttcatctattgtaatacaccagaaaaagaaaaccataatatggatgtcttgaattttgccatatgcctctttaagcagtttttacttgggtccattcctccttccctatattttcttaggcttattgggaggggaggtcagggggaggagcaatcactcaagagatccttgtctccttcctctgtaattcctattttaaagctccattcaataattacagtaattctgccacgtggatttttcaactgacttatgaagcatctatccagaaagaaagcagcagggcagaagattatgatcaggaacagtctgaacacactcgagacccataatagcaaataggtaagtggcttacaggtcactcctgcaaggcagacataaccaaccacaaccagtcctttggggtccacgtggggtcccagaatccttccaaaggcaacacacccaccagtcactactgaccaaactgagttggcatgaagaaaacacttatttgccattcctgatgtagacccttggtttaccgctaatagatggagcaggggcaagaccagaagtcagccaactttttctgaaagggccatatggtaaatatttcagatgttgtaggccataaggtctctgttgcaactactaagctctgccactgaagcacaaaaacagccacagacaatacataaaggaatgagcatggctgtgtagcacaaatgtttatttatgaacactgcaatttaaatttcatttaattactgcatgtcatgaaaaaaattcttttaatttttttaagcatttaaaaatgtaaaaactattcttagcctgtggagacaggaaaaaaaaaaacttaatggataagcagagactaattaaaaaaaaaaaaaacgggtagtgagttaattttggcccctggttatatagtttcttgacctctaggtaagacaaacttcctggtggagttctatttattggatcttggaatcttgatgaaagagtatctgaaaagatggtaacttagtgaataggtaccaagagttctcaatctctccatcaaaaaaattcctaattctgcacatggactttcttatacttttgaaattcaatgaacaggaaaatatgtaatgataaaagaccactaagaattaagtaacgattttaaataaatacaaattttattaatcacaacagtctttatatacatatatccatagtagtatgtttatatgtaaacatttattcaatctacaaagtttaatgtgtatagaattcactggccctcagcagaacacagagttgtcaatactgttcctaagtcatcagttcctaggacacagccaagtaagacttctcatcttccagactgaacacgcttagtaataatcaaaacattctgtcatcaatggttataatgactttcagtgttcctgtaaccagaggaaaggactttgcttctcagtgtatctgttgtgtttcatggaagcagaataggttttaggggtctctcaacagatactcttctctgattcatccttgaggaaaggatggtggtgggtggattgtggtagtggggaagagagggattttgaatgttttgtcagatggtgattttttttttttttttaataaaagaactgaaggacaggaaagaaagagaaaaagaagattcttgtaccccaaaataaaattcaagacattttactggtgttaaattgattatgacctaagaaatcatttaggaacagtttttaaaaacaggaaccatgttcatcatctgccaagatgaaaacccacacaataggcaggattccaactcaagccttgtatggatgtgactataaagatccagccttacacttgaactctgcaaaagttgacacgtctaagagagaccttggttcacacatcaccaaggaacccaaatcacaaaatttccccaaagggaaggtgaattcaatcagcaaaattggaaggggagaggatagtactcacctgaaacgggtgaaagtgcagactgttatctagagatgtaagtgtatgttctggagggagaacgggtctcattctgggcactgggaggcacatttaagaaatcccaaatcaaaatagtgtcatcatgggagctgctgatgatctgaaactcatcaaactggagccgaaacacacgtccagaatgttcctatgaaatacaaaacttcatgaataaaatgagatctttacagcccctgatatctcacaatgagaaactgggcagaagatgaaaatgcagccacttaaacagacttcctaaacgactgtacagagctcactgaactgtgtccttcatcccaagaacaaatgttcttctttcttttcctgctaggccttttctttcattaaactttgtatcttagactctagtctaccaatatttcaaagatcatctcaaaaagggccttataaaagtaaacaacaatacataatacccattcttgatacactctaaaaatccactggaaaacctagaaccagaaagacagtttgttttaacatgaccaggatctacctcaaattgctgccagcatcaaaattcatggtgaaataataatataagagttcccattaaaatcaagaagacagttctgcatcttctagtaaatgcaagaagtgaagaaacagaaataaaactactaaaatcttttttaaatctaccaatatttccaaatgactatctcttcaaaaatataacagtacttataaatggtataaaaatttatatatagtataaaaatgtgctgttattaaaacataaccacaaatagccatattaagaaatcttccaaacctacaagaaggaaatattgcttgccctatgaggaaaccagtccacctacaaatcaggaagcctgccttcatatcttaagctgcattatgtctccccttaggaaagtgctcacagtaatgtaaacatcaaatattctctggttttggctaaacaaaatgaagactgaaattctctgaaggcatcttgtgagacacacaagcgttcctgtgatacacctagacaggactatctgcaaatggtcatcctccagcacagggaaccaattcccgtctcaagagatcacataccaccaatgtgcgcaaacacaatgtgcttgctggggctcgagggtcaagagcagcttgcaagtcccaaactttaattttcctagaaaggaaaatgagatgtgattagtggaaaagtgaacaatttatatgctgtcaaacatttccttgaaaaaaagtagtgcatctgaactgcctatttataaaagctaatggggaacatgcttatgtttttacaaatcatctgaaccaattacacttgattttggaaaaattaagaacctacacattctcagaattgctgaaattttaaagaaatattattttaagggagataagaaaacaacttcaggttatctaaattcagttccggacttgataacctatgtcaccaaattcattcatcaggggactctctagggctgagtaggtgctgctgacagaagctagggctctgtgtgaaattccaaggatacctttctccaaattaagcaaatgctggaagttagtaataggagtacaaacagaccaactaacccatttgggaagtatatataaggtcatctggaaagatttacagttgccatttgctcatttaaaatgtagtgaggtgttttaaagagggtttgttcaatttaccaaaaagggaaaaaaagggaaaagaagaaacttattgttgaacgaacacacacacacacacacacacacaaagagcctggcttaatttagggataaagcaaagaagtcaatacccccacatcaactattgaaacctaagctattgctggagttgacagcgatgattcaaagctaagtttaggaaccacagtgactctccctctgtgtgatttggggtaagatttagttcttctttctgggcctgagtgtcctcacctaaacaacaggtataataatacctgccatccaccattacacagaaacctaccataggacctggtacatacagagttgcttaatatataacatttctctttcttcttgatacagttatagcagtacatctgaaaatctgaaagacatacccatcataggccccactgacaatcctcttgttatcaaaccggatgcatcggaccaattcttcatgtccctctaggactcttaaacaggcaccacattcaatatcccagagccttgaatgaaaaacagacctctgtgaaacaaattcccacacacgattcacactatccgtaagttttttatatctgttccatacagatacaatttttcactatcttggagctctttatttctatctcacttccagtacacaccacacatataaagctgtatgtgtacatttataccatctgtgtgtttccaagcactaacctaggaagaagccttactttttattctatttccttttatatgatttgaaactgtttttaatcatgcgtctgtattactatttaaataaaatcaacaaacaagaaacttcaattctatttaatccttaggcattctcttgatgtctgagttgataaaaaccatgtagacaaatggtgtaggaaagactcttctggggagacagggattgtaggcagtaaaggagaaagagcacagatgagacaaggtgggaaaggagatatcacgtacagccagggggttaagcttccgccccaggcacttctagcacagtggagtccataaggaccactgaggttagaactggcggaccagcaggggaggtggctgtctcttgatgaggcttggggataccccttccttgatactatatgctgaatactgggattgacggtttacaaagtcagagtgggagacttactaggtacacgcagtgttctggtggaaatataaacccattgacaacaccaagtctttttctctgcatatgatttatgtaacaattctggagttagagatcttttttcctattatgactgattttctacagtatttgtagaaaaaaatcatagctagttagcatgtacaaaataaagtgagcaaattaattctataactttttcttagcctctctaccagtaattcctatgatacatccaaagaatgtattttattacagctgcccttagcaaatcttcttagtacccgtgatgatagcatctctaatctgtgatcaaagccattcagtactgccactatgactccaaagtagttcccttctataagctggagagtaatacacattactatcttgtaaaaccttgacaattccaatgaggaagttaagaactgtttattgatgaaacattaagcaataccacaaagcatgatgaatataagagaatcaagatttaagctctaaactaaatttatggtatcttgaagcctaaagtgataaagcaaacttaaatagcttttttgttatttgcttgccttaaaaaaaagttttaataatcttaaacccaatctttattttgaccaaacattaggcaattataaacgccaaagtttagtcacttatgtaaagctactagcatgtgtttgcttgcctgcctttaaaaaacaaaaaactttttttaataatcttgaatcctatctttattttgaccaaacattagtcaatttgattataaaccaaagttaagtttagtcacttatgtaatgccactagagtgtgttgagacagtggggaaatggcatgggataatgaagtagatattgaagggatgttcttagtaagatacaaaatgtctaaggttagtcagatttattagaaagcagggaggccgagtgctgggaaggaaaaagagaggtaaatgacctggcaggaacagatgcagtcttgggagaggaaaataaagtacactcccatgtgttaggtagggaggtgggagctcacaggtgagggaaattggagcgagctgggctgcactgcagcaccctagcctgttctgaagtgctctggtattaagtgatcccaggtggagctgaggttaaaaaactttgtgtactgggggaatcttggaagaacacccagggcacacacggttttcccacttgagtatacagagcccaaatacatttctaaaagttacctaaagctttcttatctgaaacatcccatttaccctgagttgttttgagcattagaactaggagatgagtcaacaatgtggcaaaaatcagcctgctctgtcagcacaccaacttctacccacctaatggtattatctgatgatccactaacaaccaggcgatccctgtactggagacaggcaatgccccgcttgtgcccattgagagtacgaacaaattcacaggtgctcgtgctccagacctgtataacaaattaacagtattttaaagaatgaacacaggaaagtcctctcacaatatacctttcttaaaaagacagagcttctgataatgacccaaatatgtgattataaaatacggtgtcctctaactcaaagttgggaggctggggggcagactagacagcataaaattttcttggctgctgagtaataacactggaatgaaacacggagggaagtgaagtctccagtctttgagatctttacaaagagaacatctcctgaatggttcaaacgctcatttacctggaggaaagagtttgggccagattttatgtttttacaccagctgacatttcaaaccccatggagctaatgtaataaaaaagcttccagctgggtacggtagctcacacctaatcctagcactttgggaggctgagacaggagaattgcttgagctaaagagttcgagaccagcctgggcaaaatagtgaaaccccatctctacaaaaaataaaattagctgggcatggcagcatgcacctgtggtcccagctactcagggagctgaggtgaaaggatcatttgagcccagcaggttgaggctgcagtgagctgtgtctgtgccactgcactccagcctgggtgacaaagcaagactttgtctcaaaaaacaaacaaaaagtctcacctttcatatcatcctcttttccagcatattttctggaacagctccatttgttttgacacattacttctaattgtatgtatgcagaataaataatcccctcttttgtggtatctgacttagatgttcatagacagctaaacatattattagacaaataaggagacacacagcaaccagagtgccctgaattatcttaccagctgcatttgtagctgaatgggatagataaatagatctccacaagtaaaagaatggcactggacccctacctcataccttaaacaaaaatttaactcaaaatggatcaaggacctacacataagcactgaaactatacaagtcttgataaattgaacatcatcaaaattaaaatcatttgtgcatcaaaggacaccatcaaaaaagtgaaaagacaactcacagaaagggagaaaatatttgcaaatcatgtatctgataagggacttgtgcccagaatatataaagaacttataactcaataataaaaaggcaaattaccaatttttaaagtgggcaaaagatttaaatagacatttctccagagaaggtacacaaatggccaataagcatacaacaagttgtttagcatcatcagtaacaagggaatgcaaagcaaaaccacagagtaccactgcacaatcactagggcagatataataaaagagacaaataataggaagtgttggcaaggatatggagaaatcctccatgctgatattatgaaacagctattttgtaataaagctcaaaccctctcaacttccaggcactggtctcataccaattggtgtgactgtgggagtaagttgccgcatataaatcctagttgtttagcttcccagctatccaatgcaaagcctgatgctacacacttcgtgatttgtggggctaggtataagagtgctatccagtgctggttatgaaaaggaggttcttctgagcaagctgaaaccctcatataccactggcaggattgtaaaatggtacagcgcctttggaaaacagtttggcagttcctcaaaatgctaaacacaagcctgggtgacaaagtgagacctggtctctacaaaaaaaaaaaaaaaaaaaaaaaaagggccgggcctggtagtgcctgtactcccagctactccgggaggcttaggtgggagcctcaggagtccctgagctgggggactgcttgagcccaggaggtcaaggctgaagcgaaccatgactgtgttactgcactccagcctgggtgacagagtgagaccctgtcttcaaaaggaaaaaaaagctaaacacagagttaccatcctaagaaaattaaaaacatgaaaacttctacactaatatttataacagcatcatttgtaatagtcaaaaaaatagaaacaactaaaatgtccatcaactaataaacagatgaacaatgaaattttattcagccactggaagcaacaaagtactggctgggtgtggtggctcatgcctgtaatcccaacactttgggaggccaaggactgcttgagcacaggagtccaagactagtctgggcaataaagcaagaccccatctgtacttttaaaaaaaaaaaaaaaaaaaagaagggacaaagctgatgatacatgctacaaagcacatggatgaaccttgaaaacattatgctaagtgaaagcagcgagaaataaaaggccacataaggtattcttccaattatatgaagtgtttagaatagtccaatcccaagacagaaggtagatgagtgatcaccagggactgggaagaaacacaggctgactgctaatgagtgtgagggttttagagcgcgatgaaaatgttctggaactagacaatggtaatgttatagaatgctgcaaatgtactaaaggccacggaattacaccctttaaaatgttcaatcttatggcatggaaactatatctcggtaaagatgttataaaagcataggaaagctaaaattcaaaaaagttagctgagatattggaatcaggactgcatttaccatatcctagggaatcaccctagacttcaactccttgttacaagtctgcctcccccttcaccgcatgctaagcttcttgaaggcaaggacatgtcttcttcatcatcatatccctagcatccggcccagagtccaccgcactgcgagtcctcaaaattaggtgaataaataaaacatctaagctctgccactaactagctgtgatgatcaccaacacaatcctttactctctgagccagatgtgtaaaatggggccacacctaccttaaaagtgctgagtgttaactgagaccataatgtaaagctcccaacacacaatacatgatcaacacgttagcactcttccccttaaaaaggtgatcaagaatttcatgtcatgaaacagaagactgttctctcttctggaccgatggcttttcctcctaccttgcctacaactctacagatatacagagtgggatggcctcaagggttcataagcacagaggagaataaagatcttgccaggtaccaggttggtataagccacctctgctttgtctctgttctaaaagggacaggaacaggtagggttatgactgcagacatacttactttgatggtcctgtcaccagaggcagacacgatgtacttgtcgtcaaagtctactacattgacggcagcccggtggccaaccaggacacggcgtaaagtgatgtcggtcgcagaagccatgtcccacacagcaatggagcggtccttggaacaggtcaccatcagtccattgctgaagcgtaagtgcaatacagcctcattgtggtggatcaatgtgttaagaacttcacccgtgttcacatcccacactctaggagagaagagaaaagcatgatgcttaattatggagacagccaggaaatgattctggtatctgagctctgtctgggtctgcaatggtttggatatagtttgtctgactctaccaaatctcatgttgaaattgatcctcaatgttggaggtggggcctggcaggagatgttttgggtcatggtggtgtatcactcatgaatggcttggtgccattctcataggagggagttcactcttagttcctgagagaacaggttgttgaaaagagcctcctagcacctcctccctctctcttgcttctctctcacatgtgatctgcacatgctggctcccctttgccttctgccatgagtagaagtagctcgaagccctcatcagaagtagatgctggtgccatgcttcttgcagagcctgcagaaccatgagtcaaatacaccccttttctttataaattacccagcctcgggtattcctttatagcaatacaaatggagtaagacagggtctattcttaatgaacctaaggacatgattaaaaggggcccctaaaagcaatttctttatttgctgagaagtgctgagatggtttcagaaaaggtggctaattctggctctgcctgagtttaggtatatttagcagtcaggtatttagggacggtgtttgcaggctcgtgctgatggcaaaagatgattcctctagatagtagattttgtattgagtctgagatgacaggaagaaggaggcttgttggctgaagaactgagaatggttccaagcttagttcttgttgacctctgacaggcctctgagtctatcagttatccactgcaaactgggtaagtcatgatgcctcatcaatcaccgcatccacttctttacccagctgctttatggacaaagccagggtctcccaactgctttgtagatccagggatctggaagcagcatttccacatcacggcttttctgtaaccctcatctcctaagaggacaagttcacatagggcagagggggaaagactcaggcctctgaggctgagacatgatctctggcagaagcaggggtacggaagcactgagtccaggagaggatactaagcatgcttcaagcaggggtggcgatgcttccagcaggggtggcgaaagagtccaggagtgactcctggaagtgagtgtctcctctctgctctggaccacataaccaaaagaagaaagccagcctaatacttggtatatgctcttacaggaaagcatgttgtcatctctacaatgaacagcaataggaatagaacacccttaacaaaaattagctttcctgcctaatttgcgcaaacatgtctacaataaaagtagtttgaaatacagcatgtaaaaatgtaagtttgtgtatgcctctcccagaggaggatgtcaatctcagactttctcagggaaggcttacaagttaagaacaatgaagccagatcactcacctcaccgtagaatctgaagagccagttacaatgacacgctcatcatactgcagacagaggacagagcctgtgtgtcctgttaacactttcaaacattccaggctggttttatcccatatctattgagacaagattagccacaaacgatgattaattatactatattttgatgaatgttactgtcccaccttatgttctgattataaaataaaacacacttgggttacagtaaataagaaacactgaataacaaacaggtaagaaatgacaagaaggaatacagacaatagtgattaactactaggatagatgtgctattttgcttaatttgaacccttagctattgatctcagtatacttatcaacagcctcataaaggggacttcttaaaaataaaatctgtgaaaagaattcgctcactgactgggtgctgtggctcatgcctataatcccaacattttgggaggccgagacagaaggatcgcttgagcccagaagttaaaagaccagcctgggcaacataccaagccaatctccataagagtgtgtgagtgtgtgtgtgtgtgtgtgtgtgtgtgtgtaagagagagagagtgtgtgtgtgtgtgtgtgtgtgtgtgtgttttaattagccaggtgtggtggtgtgtgtgcctgtagtcccaactactcaggaggctgaggtgacagaattgcttgagcccagaaggcaaggctgcagtgagccataatcacaccactgtactccggcctgggcaacaaagcaggactctgctttgtcattttatttttatgtctcataaaaatattaatgaaaaagaattggctcactctctggaaagcaacatgacaacgtctattaagaggttttacaaatgcatacccctacgtttacaaaaacaaaaagtggaaaatgaaatgtccagcatttcataaaagtctcaaagtaaactatgaagtgtttaatgagaaaatatcatgctttattacaaagttaagcattttaaaaatcagaacaaaaattatctgtaaagtgacacaatgactatgtatattttagaaaaggaagaaaggattaaaggaggtaaaatgttgtgaacagttgttttcacactctgagtgttccttttctcgcttcttttactgcctccatagacttgtcttttctagaatgtcacagatttggaatcatacagtatgtagcctttttagattggcttctttcacacagtaatacacacttacggttcctccctgtcttttcatggcttgatatacattcctttttagtgctgaaaattatcccactgtctagatgtactacagtttatttatccattcacctactgaaggacaccttggttgcttccaagtttgggcaattatgggtaaagctgccataaacatctgggtgcaggtttttgtgtagacctaagttttcaattctgttgtgtaaatactaagtggtatatatggtaaaagtatgtttagtttcgtaagaatgccaaactgccttctgaagtggctgtactattttccatttccaacagcaatgaatgaaagttcctgttcctattgctccacattctcaccagcattgggtgttgtcagtgttctggattttggccatgctaacaggtgtgtagtagtgtctcactgttataattcacatttctctgatgacttacaatgtgtaacatcttttcacatacttacaatatgccatctgtatatccttctttggtgagatgtctgttaaggtctatgccttatttttaaaaatcaggttaagctaattgttttttttcttactgttgagattcaagagttctttgtatgtcttttgcatacattttctctagtctgtggcttgttttttcattctccagacaatgtctctcacagagcagaaatttttaattttaacaaagtccagctcattaattctttctttcatgggtcatggctttggtattatatctaaaaagtcatcaacaaattcaagatcatctagattctctcctatgttacattctgtgaattttaagattttgtgttttacagtcaggtctttaatccattttgagttaatttttgtgaagtatataggatctatgtctagactgtttaagggtaagggaggcaatatggtgtctaattgcttctgccccatttgttgaagacacaatcttttctctactgtattgtctttgctcctttgtaaaagatcagctgactatatttatgaaggtatatatttctgggctctctattctgttccatggatctagctgtccattctgttgccagcaccacaccactgtgatgactgcagttttacagtaattcttcaagtagggtagtgttagtcctctgtctttattctacttcagtatcatgctggtttttgcttgtccatataaacattacagtcagctggtagatatccacaaaatcacttgctgggattttgattgagactgcattgaacctacagaccaatttgggaagaaatgactgacatcctcacaatagtcttcctacccatgagcatgaaatatctctccccatttatttagttctttgatttctttaatcagttttatagttttcttcacatagatcttataaatattttgttagatttatacctaagtatttcattggtgggggaggtgctaatataaatgttattgtgttttttgagatggagtctcactctgtcacccaggctggagtgcaatggcgcgatctcggctcactgcaacctccgcctcccaagttcaagctattgtcctgcctcagcctcctgagtagcaggactataggcgcccaccaccacacccggctaatttttgtatttttagtggagacggagtttcaccatgttggccaggctggtcacaaactcctgacctcagatgatccacccacctcggcctccctaaagtgctgggattataggcgtgagccaccgcgcccagccatgttattgtgtttttaatttcacattccacttgttcattgctgctatatgggtaagcaactgacttaagtatattaaccttgtatccggcaaacttgctataatcatttattagttctaggaggttttttttgttgatgctttcatttttttctacaatcatgtcatctacaagcaaagacagttttaattcttccttctcaatttgtataccttgtcttagtgtgttatctaggagttctaatacaatgttgaaacatagtggtgagtggggacatctttgtcttattcctgaccttagtgggaaagtttcacatttctcagcactgtgtgtgacgttagctataggctttttgtagatactctttatcaagttaaggaagttcccctctattcatagtttactaagggtttttatcacgaaagagtgttcaattttctcaaacgccctttctgcatctattgacgtgattttcttctttggcttattgatatgacggattaattgatttttgaaggttaaacatgaagatattggtctgtggttttctttgaatgtcttcatctagtttagtactaaggtaacaatggcctcatagaatgagtgatgaaatattctctcttcttctatcttctggaagagattgtagagaactggtgtaatttcttacttaaatgtttgacagaattcaccagtaactcatctgggcctggtgctgttttggaaagtaattaattattgactcaatttcttcaacagataaaggcctattcagattacctatttgtttttatgtcaattttggaagactgtgtctttcagggaattaattcatttcatataaattatcaaatttgtaaacagggagttgatcatattattttattattcatttaacgctcatgagagctatagtgatgtctcctctttcatttcaatattaggaatctgagtgcttttttttctatgttagcatagctaacgtaattatcaattttactcatcttttcaaagacacatcttttggtttccttacctatttctatggatttcctgttatcaatttcattgatctctgccctacttttcattaactcttttattctgcttactacggatttaaactgttctttttctagtttcctaaggtggaagcttagatgactgatttttagtcttttttctaatatatgcactcaatactataaaattctaagctttcactgcatcccacagattttgataacttgggctttcattttcatttagttacacccacccacacatgcacacatgtgcacacacacagcgaaggaggagggagagaaagtctcacaccgtcactcaggctgaaatacagtgacacaatcacagcttactgcagcctttgacctcccgggctcaggtgatcctcccacctcagcctcttgagtagctgggactacagacgcatgccacaatgcccagctaatgttttttaatttttttgtagagacagggtctccctatgtttcccaggcttgtctcaaacttctgggctcaagcaatcctcccacctcagcctcccaaagtgtagggattacagacgtgaaccactgtgcccagcctcaaaatatttttaaaatttctcttgagatttcttctttgatccatgtgctatttagaattatgttatgtaaccttaaagtatttaggaatttttccagcttcttttttttactgatttctagtttatatccactgtggtatgattggacattgtattaatttctagcctttctttttttattgcttttatttttttatttttccataagctattgtacaggtggtatttggttacctaagttctttagtggtgatttgtgagattctggtgcactcatcacccaagcagtatatactgcaccatatttgtagtcttctatcccttgcccccctcccactcgtccccccaagtccccaaagtccaatgcatcattcttatgcatttgcgtcctcatagcttagctcttacataacagtgagaacatatgatgtttggtttttcatcctgagttactttgcttagaataacagtctccaatctcatccaagtcaccgcaaatgctgttaattcattcctttatatggctgcatagtattccatcatatatatatcagtcacagtttctttatccactcgttgagtgatgggcatttgggttggttccacaattttgcaattgtgaattgtgctgctataaacatccatgtgcaagtgtcttttttaaataatgacttattttcctctgggtagatacccagtagtgggactgctggatcaaatggtagttctacttttagttctttaagaaatctccccaccccacaacaggccccagtgtggggaggcgggagggatagcattaggagatatacctaacattaaatgacgagttaatgggtgcagcacaccaacatggcacatgtatacatatgtaacaaacctgcacgttgagcacatgtaccctaaaacttaaagtataataaaaaaaataaaagaaaaagaaatctccacattgttttccatagcagctgtactagtttacattcccaccagcagtgtagaagtgttccctgttcatcatatccatgccagcatctactgttttttgatttttttattatggccattcttgcaggaggtggtatcacaatgtggttttgatttgcatttctctgatcattttatcatgtttgtcgggcattttttcctgtgttgagcattttttcatatgtgtattgactattttgtatatcttcttttgagaattgtctgttcatgttcttagcccactttttgatgggattgtttgtttttttcttgttgatttgtttgagttcattgtgtttgtttttttcttgttgatttgtttgagttcattgtagattctggatattagtcctttgtcagatgtatagattgtgaagattttctcccactctgtgggctgtttactctgctaactgttccttgtgctgtgcaaaagctctttagtttaattaggtcccagctatttatctttgtttttgtagtatttgcttttggttcttggttatgaaatccttgcctaagccaatgtctagaagggtttttccaatgttatctcccagaatttttctagtttcaggtcttaggtttaaagtccttaatccacattgagttgatttttgtataaggtgagagatgaggatccagtttcattctcctgtatgtggcttgccaattatcccagtactagttgttgaaaagggtgtcctttccccacttttatatttttgtttgctttatcaaagatcagttggctgtaagtatttgggtttatttctgggttctctattctgttccattggtctatatccctatttttgtaccagtaccatgctgttttggtgactataagcactatagtatagtttgaaatcaggtagtgtgatgcctccagatttattctttttgcttagtcttgctttggctacatgggctcttttttggttccaagtgaattttagaattgttttatctaattctgtgaagaatgagaaaggaatggttatgtcctttcctggttttggtattaggtcgtattttgacagggactgcattgaatttgtagattgcttttggcagtatggttattttcacaatattgattctacccatccatgagcatgggatgtgtttccatttgttcgtgtcatctatgatttctttcagcagtgttttgtagttttccttgtagaggtcttttgactccttgattaggtatattcctaagtatgttatttttttgcagctattgtaaaagaggttgagttcttgatgtgattctcctcctggtcactgttggtttacagaagagctactgatttgtgtacattaatcaaaaggaaatgctataaacaggccttcaagaagggaagcgttctatagttccatgactaggtctgagtcttttagtgagcctatacctctagacttcacaagtacttctcagttcttcctcacccctttatgcgtgaccaaatggatgagggggctggagttgtgtatttcccttccccaggtcagtcaggttctataaaatctcagcactttaggctctggctaagcagtttctactgaaggtagaccttatcaagaagtacagaataacctagtatagttttaaaagtttcttttcccttcccgctgctggaaacacaaggagatttttctgggataatcactgagagaatctggtagagctcttgcaggtaaaactcacaaaagtgtggtggggagcctgatgactgggtcctcctcagtttatatttctcagacttgtcccacactgagcctccagcaatttttcaattacggttcaggttaccctacccaggcactggttctcccggatgtttctgctccagtgagttatgattctctgtatttgcctgtctctccaatttgtggggcagcagcttctcctgtgacctcacttctcttatgaatctaagtagaatggttgatttttcagtttgttcagatttttacttgttgtcaggacaagtagcaacttcttacgtaccaaacccactcccttcttttaatctttccagtgttcccaagttaacaatattgttgatatttaatgggagatgagaatgttttcaaagattgaactatttaaaatagactctgtgcacctatttcttgacatgtacaatactatcataatttgtagtgactctacagtttactgcaagtgaacaagattttataaatgaggtagacactgaaatataatatctacaatagcaaagcttgcttttaacttctgacctaatggaacctgagttattttttaaagtgattagtgatcaaggattggtgcagaatagagcaaaaaaaaggtttccaaccactggtctagataatctcttcaaagcgcacttctgctctactattctatgtcttattaagtcaaatggatgtgccacaattaagagaattcttcagaaaacacatctagtgtaaatgaattccaagcccacagccagactatgctttgacaaagttgttataaaccattcttaactattccttaaagaaaaactaccagtattattgcagcactattcacaatagcaaagacttggaaccaacccaaatgtccaacaatgatagactggattaagaaaatggaatactatgcagccataaaaaatgatgagttcatgtcctttgcagggacatggatgaagctggaaaccatcattctcagcaaactatcgcaaggacaaaaaaccaaacaccgcatgttctcactcataggtgggaattgaacaatgagaacacctggacacaggaaggggaacatcacacactggggcctgttgtggggttgggggaggggggagggatagcattaggagatatacctaatgttaaacgaagagttaatgggtgcagcacaccaacatggcacatgtatacatatgtaacaaacctgcacgttgtgcacatgtaccctaaaacttaaagtataataaaaaataaataaataaataaataataaaataaaacgatatattgatagaaaaaaagaaaaaccaccagtattaaatagtagcatatgtcacactttctagagtatactggtagccacaggttagggctatcaagtatatataaaaatagagttcggtgggccaggagcagtggcttacacctgtaatctcagcactttggtaggccgaggcaggaggatcatttgaggtcaagagtttgagaccagcctggccagcatagcgaaacctcatctctactaaaaacacaaaaaattagccaggcctggtggcaggcacctgtagtcccagctactcaggaggctgagggaggagaatcgctcacttgaacccaggaggtggaggttgcagtgagccgaaatcatgccactgcactccagccagggtgacagagcgagactctgtctcaaaaagtaagaaaaaaaaaattaaaaatagagttccgtggtcaaataagttttggaacttgggaaacactgggtgtctgtctctattgtaggcattctcagagcctttatatgctactgtatcctgtgaatttctaagctggagacacagcatgcagtgttatctaaacttccttggagggcattattattctctgcctagaatgcctgccaacatcctctagattcacatccacagaatatcttttggcaaacactgccatacatataggaaaccaacagaacagtttcttatattctataattcagagtgcgtttgacctaggtagctgaattactaaaattccactatttcactttttaaaaaacaaacaaaaaataaaaattaaaaaaaaaagcagaaaagctttatttcacccaaaatagaacaataacagaaaacagggccaagatggagaaagcccactacaatctatctctccagttgattataactaaacactcctgataaaaactagttaagaactctgaaaagtaaggggaaagaggggacaacaggtagatgtggcaaggggtcaaaatgtgaagaaacaatctgcatgggggtgaatttgccattatttttctttgttgttttctgttttctttctttttttttttattttttattgagacagagtcttgctctgaattgcagtggtgtgatcctggctcactgcaacctctgcctcctgggttcaagcaattctcatgcctcagcctcccgagtatctgggattacaggtgcccaccaccacgcccagctaattttttgtatttttagtagtgacagggtttcaccatgttggccaggctggtcttgaactcctggcctcaagtgatccacccgcctcagcctcccaaagtgctgggattacaggcatgagccaccacacccggctttttctcttttcttccttctgtggcttttgctcaaaggcaggcccttgaccaggaagctatacagtgaaatagcaaaacatgcagctaaaattctgaaagaaatccctctaggcagaggggctggaaaaaaagagatccctgggggtttcttttctctcttctctcacagggctcatggctccagtcatgacgacacactgcagaacaatggaaaagataaaaaaattccaagagtgacccaatttttctggccagaggaaaaggaaaaaagtgtccttatgggctgaagagacttagggaaatccaagaggaaagaactggaaataaaagaacccaaacaacacatgacttgggcttacccttgagctgtatatgcgcagaacagactgaaccagcacagcaaaggctgtctcaatgagctgatatttaaagcactgctgaagcctcagattaacctctaagtagtgaaagcccatgacagacgcaaagtggcatattgcaaaggctttgaacagtggaaaagagattagagccatccccgcaacccctctgatgatgtcaagacagaacttgtgttctgaacccaactaagttgactaactgcttaaaaacacacttacccaaaaacattgtccagaggattataacaggacccacagtctttacaacataatatccacaatgcccaaaatactagtttaaattacctggcatacaaaaatcaagaaagatgaacaatctcaggggactggacaatcaacagatgtcaagctggaggttacccagatgctgacatggttaaagatgttaagcacctactctatactccacaggataaagataaacgtgcttgaggtaaataaaaaagagagaattctcagcagagaaatagaaactgtaaaatatcatacctgaaattaaaaactcacttgatggggcggagggtaacaggagaatagagatgaagagatgaaaaattcagtcaacttgaagataggccaatagaaattatccagaaaagggaggaacaaagattgaaaacaatgtggaacaatatcaaaagatatagtatttatgtgattagagtctcagaaggaaaggagaaattggtacagaaaaaaatatttgaaaaaataatggctgaagacttctgaaatgtaatgaatgaaagacgtaaatttacacattcatgaagctcagagaaaggcttcttggatataatatcgaaagcatgatccataaaagaaaaaactggtaagttggacttcatcaaaattaaaatcttctgtcaagtacagtggctcacgcctgtaatctcagcactttgggaggccaaggtaggcagatcacctgaggccaggagttcaagaccagccgggtcaacatggtgaaaccccgtctccactaaaaatacaaaaattagctgggcatggtggctcatgcctgtagtcccagctatttgggaggctaaggcacaagtattgcttgaacccaggaggtggaggttgcagtgagccgagatcatgccactgcactccagcctgggtgacagagtgagactccatctcaaaaaaaaaaaaaaaaaaaaattaaaatcttttgctccattaaagagatcattaagaaaatgagaaaatgaaaagacggccaggcatggtggtttacgcctgtaatcggggcactttgggaggccggggcaggtggatcacctaaagtcgggagtttgagaccagcctgaccaacatggagaaaccctgtctctaataaaaatacaaaaaagtagctgggcatggtggctcatgcctataatcccagctactcgggaggctgaggcaggataatcgctcaaacccgggaggcggaggttgcagtgagctgagatcgtgccattgcactctaatctagcccaggcaagggtaaaactccgtctcaaaaaaaattttttttaaataaaaagaaaatgaaaagacaactcactaattgggaaaaatatatgcaaaacatatctagcaaaggacgtatctagactacataaagaactctaaaaactcagtaataaaaaaacaaagaacccattttaaaatgggtaaaagatctgaaaagaaacttcaccacagaatatagagatggcaggtaagcacataaaaagatgctcactatcatcactggggaaatgtgaatttaaagcaaaatgaggtatgttcacatacctattagaatggctagtatcaaaaaaaactgagatgatcaagggctgacaaggatacagaacaaaagcaactctcaggccaggtgtggtggctgctcacgcccgtaatccccgcactttggggcaggcgcattacttgaggtcaggagctcaagaccagcctgggcaacacggcaaaacaccatctctactaaaaacaaaaaaattagctgggcgtggtgccacatgcctgtagtcccagctactcaggaggctgaggtaggacggcaggagaattgcttgaacccaggaggcaggtgacagagagagactccgtctcaaaaaaaaaaaaaaaaactctcatcactgtagatgggaatgtgaaatggtacaggcactttggagaacagctgggcagtttcttagcaggtgaaacatacacttaccatatgagccagtaaccccactcctcagttttcacgcaatgaactaaaaatttatgttccccaaaaaacctacaggtatataattatggtagctttattcataattgtcagaaactggaaacaacacaaacatccttcaacaggtgaatgggtaagcacaggaaagaggcagaaaagcccaggataagaaacgggcaggacaagggaattgggggaatgagagagctgctccatatcgtgatttttgtaacagttatacatgtctgtgtgtttatcaaaattcacagaattatacaacaaaagagcaaacttccctgtttgtaagttataatgtttttttacaaagtttaaaaaacatgttttcttaaatatgaggacataagatacaaacaatgtaaaataaaatcagatcagatcagccatcaaacagattaaacatggaaaaataatccagtttatctactactgaaaagttaatgaaaacaatataagttgctctatcattctgtggtattattatttgagtccttctcaggaaccataaaaggtaacacctttggtttataaactaccaataccagctggcaaagtaatcaagagccctgtgatactgggatattttctatttacacctaatacagaatatagaatgtgaatgtgcttagagaaggataagaagtgagacaatccagggtcttgtattagtttcggggaaatgctctggctctagttctttagaactacactgagagctgccaagattgagtggaagagataaaaaccaatctagagtaaatggaaagattgtcacatctagtgtctaacacatagccacgattctaaaaataatacataaaaaattcagtcattcaccttaatagaattatctcgtaggccactgataattttttcatcatcgtactgtaaacagtagacacctttactattttcagagcggcactgaatcctctgcaagttgtgtcgtccacaccgccagttagattctatagtctagggaaaaaaggaggcaagagatgagtttttatgaatcaacttactctattaggtttcagactttggcgttgcttccagaaacagcataccaccgataccccaatcttggtttgcataactgtctgtggataggatcatgctcttttccaagtaagacattaacccaacaatgttttttcttaaactttccctgcccatttggcaaccgtcataggatttccaatgagttttggactgggcttgaaaaaactggcctagacagaattcagtatgtttaaagaacgccgtttgcacccaaaacatgcaaataaatagtaactcattgggtcgctccctaatgccaattaaaaaaccatcattaagcatatattgacaatctacatatccaaacaaagaattgtcttgatcactgaggaaagatagtgagcaactactataagccaactacataggaagaattttatcatttttaaccttcctaatgtttctgtagagtaaaaatggtacattttagccctagattcttattcctcttatcattcatgcaacatttgctgagatgttaatatattccacatagtgtgctaggcactgaggataaaaagatcaacaggagacatactgcattcagggaggcaccactccaatatctaggcccatggtgtctggatctagagagacactaaactaagtgtatttggttaaatgatccatacaataaccttggaaggaaggaagtacttattatttcctttttacaaacaagaaaacagagtttaatttgcctgcagccacaaaatcagtaatcggactagctggaaatcacactcagttctttccgactccaaacccatgcttttgctactaacatattcaatgcccacaaagcaggatgggcctgcctcttgcggcagtgcacacagaacgtaagaagatcagtaacaattccaaaagtgccaaatgagtgataaaaattctaagtgctgcaggacttaagggagataatgagctctatagcctgagacactgggacaagtttagtgaagaagtaggtcatacccagagcaccagaagacctaacctctggtagtagacataagtgattttttaaggctcaaaagatacaatgtctctactaagagtaactaaagtctgaattcttgatccttgaaattaggggacaacagggatttctataacctgttacacttcagttcaggatatagtttctctctgagtagctaattatttctgtacagctaaaagtctaattatttgctttgttgaaggagtacttaattactggctctgctgacatctaacaaactgtatttcttcttattttgaagatagtatccttctgtgcactctaaaatgttacaatttactgaaagctacatgccaggcactatgcttttctaacactataccactcactttatatgttttgtagctaatttaatcgtgactctgaagcaggaatcattgttcgcattttatagaaaaggaaatggagggttggagatatcgatacacgtatacttaaaaagcgattatttccatcatttgtggccccagtgctcagcaagagtcctggaaatacggtatcttccctcaaggagctcccatacacatcctgagggcaggatggtatatttccaatgctcaggagatacaaggaggtgccatggagatgccaggagaggggaaatactcatttgtccatctgccaccaaatcagaacttcctagcctgggtcatcatctctagtgacttggtaaaatattagacatacaaaagcacacttcaaaaccaaaaaaaaaaaaaaaaaaaaaaaaaactaacccaaccatctctgctacctctatcaaagtagacaacagatctgtccggataagcgactttttaaaaagaggtccagaatacaggcatttcttaagcagaactcaacgcatggaatcatttagagaaacaatgtatttttagatagtgactgtgccatctcagcatgctaagcactccaggaaaatgctgatttagtaggcagatgtactggtaacaagtctaatttgtggccagtgactcttggcagtagttaccaatgttcacgttataccctctgggggcccacagagttgctacagaatgtatgatgtcatattacaagtatgacagagatgaatacataatatgtctttacatatatgtcaagtgttatcaagctgttcttaggtttaagaggtatacaattgctttaaaatgacactgaagcagtaagtagctttgttatgctctatatttcaatgactagaaaaagcacatttactaccgcatgagagtctgagggggaaacaattattttaatttaaaagaggggatgggggggaatctctataccaaaaagaattttctccatgctctccgctgctctaaaatgtttcctagaagtgggtgatgtggttacaatctttaactgtacccaaaaccctgaagacgcagcagagaagactacacagaggagccagggtcaggtacatactcagcctgtgatacatcagtcccctgagatgtctggacagaggacgacaacaacattaaaggctgggctataccctctatccccaaccctcaagtaagagctagggaacaggacctctcaaaagctctgctagataccagactttcattctaagttgaacagaagttagcaaatggcttagcttctcaacacttataaaaagcctacttttctcaaataagtttctgcattttaaaagaaatagtttgtcaaccaattcttgatgtgtcattttacaaagtcctcgcctaggcctgttttagaatcattagtttcttgaatcccaaagtgcagcttgctttgaaaagccacgaaagagacacggagccagatgagggagttgactgctttgctgcgcaccaatcctgggtaactcctcttctcaattcccaaggccaccggcacaagaaagcagcacttcctgtcaactacgccggcctaaaaaactgcccccatgatgtctgacaaccttgactcttacttgaatgcttataacccaggtctttttttttttttttttttctagaaaaaccagacctttaaaactggcaggtagcccactgtggtagaaaatacctaggtcaagtagtaactttggcaaaggactcgctgctgtaaagatgggaagagtaatatctactccctcaaaaccactgtaaggttcaaatgagattatgtatataagttctcattatggtgccagcaaatggtagcagttatgttcttcttcagttgttgaaaacgttaaccaaaaaaaagtgggctgcaacaacaaatacatatattctcacaaagttgccagaaattgttgtctcagtctaggctgatatttaatgctaataagcctgagccttccctaaccattcccaggaagaggctcagccttcaaatggaatccaactattaccttaatgccagcagcaggaacagaggtcatacacaggtgcacctctttatatggatacctatcatttcacttagccatcatgtggtatggctactgtagaggaatatttcatgtttttgagaacttgtaaaatccccttaccctgcgcaaattttcaaaatactgggaaagtagccatgatacacagagtatacagcggcatttaaattggcaatagagtgaaaacagatgtctgagtatggaggaataacattatttttagaagcctaaacacaactgggtgggtgggcaagttttgacattttctggtcaggacaatgttaatatcaggtttgcaaaccacaaaaaagctccccactttccctgaataaaatgtggcttattaaaaggtgtgatacaacacaccatcatcttcccagtgtctgtccaagaagagcacttcggaggcgttaatgcaatgaatgaagagaggaagaaggtagattacttgaaggagtttgtcactactcaaatggcaaaagagaaaaatccaagttcagaataccagaactctagggctgttataacaactcctatctctctgttaatagacaattgggggcacgctagagtgaaagcagcatgggctttgaagtaagaatctcagctttgacaattcgaggattaaattaaatcacttgtagcaaagtatccagcagtcagcccaccattaatggtaacaacaacaataataacagcaacaactaagactctagacagcaaaggagaatatggctgcttcttttaggagcgagcctcaggttttctaggaattccttctcaattcagaggccctctaaaccctctctatgtgtggcaagaacacccaggcgagatgagcctttgcagaaagcttacaatacttatttattctccccagactccatttctcacatcctcatttcctgaataacaggagttggctgcactaagccaggttctctattttcccttaaaattaagccaattttcggtgggtcaatgtagaagcgcagattcagagatgaacatttcctttctcctcatcagagccaaatctgggaacgtacagattacaggagctggcacataagccaagctgtcgaggtggaggaagaaggaaaaaaagaaaaaggtgttgtgaactggcaaccttgcaaagtctaagggaaacaacacaagagactctgaagctatgtacaggcaactggggagggaggggggacataaacagccacttgacattccaagtgtcatttatctttctgcaatgtgcttaaaaccctactactttcccataactggactaaaacagggcccactaatcagatcttaactcatacccttttttcaacgaacagtcaaggacactgcgtattcacacaattagagaaagaggcaaaggccaccttgaaattcagcaggcataaaacatgcctctttctccctcacttcctgaattttccactctgaaaatgacaaacaacaactctcagcctggatagagctagacagacctcagttaaaagcccatcccatctcttctacttaactatgtagcaagtcctaaaacttcttttagtctcagtttccccttattataaagataataacatgcaccttgttgtaagaataaaaaacaatcatctatgtaaatcacccaacgtggtttgatatatgcaaaaactcgaagtgggtatttgtaattattatagtctgcttgtgaggatttcataccagtcatacggacagagccaagcccgtgagaggctctcatttgatccatggatcactggaagaactctctacataaaactctatatattctgttttattccagacagaataaaacacactctcaaaatgggagtaaaaaaaaatctattttgaggtggtagcagtggtctattgttaaaaactcgtattaagggtagaagggtacatggttgatcacagactctcaattacccactagctgtgtgatcctgactaaactgtttaacctttttaaccttctaaggtttcctcaaatttaaataagtacttggcctacctttcaggttttgtccaaaatgttaaaagagaaaatgcattataaagtagttaacaaagtatctggcataagtaaatgctattagtggtacattacttttatgattattactagtagcacatatatcaaagtataaacatcatcccttatatcaagaggtctagcccacaaaaatctggagaagacttttgtggccaaccagtgggtttttccaaaccacactttaagaaccactgggtagaccaccatgatgtagaggctgtgtcgcacagggttttcccacagagctgtttcccctcacacctgcctcctctcctactttaaactatcatttcagcctgaagaagtgatgatggcaggtggtgtcagatactgtcatgccacagaatactgaattcacattgtcaattctaacagcagtcatgaggattcaatcaaactatctatgttgccacatcttcaacctgatcagagttcttcaaggttcctgtttgttcataattaactttaaacatcattcttttcaaagaatttttttgataaaattattcaaagaagtctggaaataactttgtaaatagttgcccctcatcaagtgaaaaaaaaaaacagagggtaatgtagtttataagatgtgtacataagaaatgccttagtacaactacctggggtaagagacagccccatctcccctacaatacacacacatcaacctaagattaaagttaacaccatgtctcagccactagcactgtaggggcaacttattctaagtttggaactgccaatggtcaattaattcttaaactttatgatttatctagtgaaagtttttatttaacctccttaaagggttactttatagatcatttcagagagcagaatattcaagacagtttgggctttaaataatgatattccagtcacattcagatttaccattaatggaatgattccattattcacatctgcctggaagggtggtggggtctgaaaaagcacatgtttctccgttaatgaattttggcacaataacttttatgtctatcacctgggggagaggattacttcacatttgggaaactgagtataactttatgggtgatattgcattgcctagcaaaggctaaagttttctgccaaggaggaaacagtgaagtaaccaagacctgccaagaacacatgtgaaagagttaatgagaaatgcctgtgcatgtctttcctggttcaaggaaaaaggctaaaatagtaaaactgaactaattagaacacatgaacgatatcaaacatctccaatgtttctcatcaagtttacagagttttactggtctggtgaagttacgctcaaatccaaaatggtccaggagcataatttgccctataaaatccacttaactattgcttagaatgatatctgagtcatgtttatgaaaaactatgagtaatgtacagagaaaacttgaaatgtgccttctctagttctctagagatggctcaaaaatgtaaaacaatgcttacttaaaaaaacggggccttggattttggaaaatttatcagcttagaataaaaagatgattttagattaaggtttgaattaaccggcagccttgcagaagcatttcatgttttagaaaagttagatattctttgcaaaagacattattttctctgcagaatagctgcagattatatacaacatgacacatttactccaaaagctcaactttttaaaaaaaattattagttctacgattttagaccaaaagaacactctaaggcaacataaaaagttgagaacaagaaacaaagagcccataaaacagataaatcataaagttacctctatatcctggataatctttgggtataatgacctataaaatgaatttggagggccatctgtgggtctgtttttaaacaggtactgatccctggcaaataaaaacaaacagatgttacatttttgcacataaaagggtgaattttatctaaacatggtgctgacaaagatatatctttcatgtcttttaatttgcattgagttttaacagttcaaaagcaggatttctgacaaatttacatgttacagacaagtttagctcaattcacagctctctaacaaaatcctgatcgtgttttctgagtactaatatgtaacaatctagcctttcattccatagagtttaataaaaagcgctaatgtagctttgtgaaaaatctaacttagtacacatcaaacttcctcccgtaaggaaaatacagccctatatgcacctctgtctgtagctctctctctttgctaactgggccatacagcatacagctagctataaagctgcatcagagttatgagttttctctgaaaaatcctatcactgttattacttcctcaaccagcagtaataacaaacagcaaaatggcactatctgactttctcatatttttgtcatatctatattttggtaatggtatcatcaactaagcaaaatgtgaaggaaaaaacataaatacatagctttgaaacgccaaatcccatcaaactatataatacagttcataaaggaaatacacatttcagagggagaaattttaacagctttaactttttcttccaacttttgaccactcattttcccccctttttaaaaataggccagcacatttgcaagtataattgcatttttgagtaatcaagctgactctatgtcaataaaattttttcaagggaacaagcaacccaagtacttaccaccctcttctttctgaaagtcctttccataggggatcagtgcgtaccattcgttcaatcagcttcttccaaagcattccttctgagatcactcgctgccattctttacataccagctctgctgcacacagagacctggcatccaggtacgaaagaatgttttctgctatgtgatctaagccttgctctacaaaacagaaaagggaatgaaggaacgggaagagagatagaaaggtaccagccatcatttccttaaagataagaggaataaagaaatcctgaaccaagtaaaatattttagtcatatcaaaagttctacagatactcaaatccatgagtacataaacatatacacttctttttggttctgattttttacgataaaacaattgatagcaactcttctctgtgtgtaaaagctgaccttggacagttctgttatttgtcaaatattaagataagacttttcattttcttttatataactctcacagcactcctatagggcaatgacgccccaagtttgacagatgaagcacagaaaggtaaagaactcaagattttacactcccttggctttactactggaactcggatttcttgcttcaaagtttgtgttcattcccatcttactcactgtctctcataacaaatcatatccccattaatccatacccggtgtgaatccctgggagatcagaagacaaaaaaggcaaaacaccgactcatcttgaaaaacttatgaaaagttaaatggcaatccaagaattaaagtcgattgtgcttaaatgtatttttgtcaatcttttcatctccctttcgtgagtatccattttctgttcctaaacagatgggacaatcctcaaaagcaatagccccatgtctacaaatcctagaatcttagaggtcattggcttcaacctcccacgatacaaggatactctcaaagaaaaccactttcagcctctgcctgacattcacaatgggaagatgatcaacatggccaccactgttgccacctgtaaactcccatcctgtggcggtaagtatgtcttctacagttgcaagaaataaagcttctccccaagcttattctgtgtagggacgagaacacagaacttatcatcagaaaattcccatttcaagtcccaggttcaccacttactagttctatgacatgaaacaaacactgaaacatccctgtgccttgaatttttgtgccctaacatacaaaatggtaatcaccagtaacaactatcctttcttacactgtctgtcagaatcaaattcaacagttttatgaaaacattttatagacaagcactctacaaggttaatatctgttctcttttctcaaaataattagaagtagtataatagcactaaacttggttgttgaaaggccagatgtaggtaaattattaaactttcagagtcagtttcctcatctgtataagattacgataatctctacttgattctgaaaatatcaaaatgagatgatgcatgaaaaatgctttacaaactaaagttccttcaattctaagaatgactattattataccattggttataatttccaggtccttcatatactaaaattctcttactctggactagatcaaagacccaagctatggtctaagaataaagactacactgggaccactgtcctttcctgcatgtcatttacagttaatgtggtcaaaggctgcactgccttcatctgatagtcatatcacagaagacgcctaagatggcagtaagttagaataaaatcccaggcctctcccccaaaaacatctattgaaacaatttccccgaatgctctatttgcacagctagttggaaaggtggggggcagctttgtgcggtttatatttatccttactataattcaccttcaaagctttgtctgacccatccatttcagtctctagaattctgatttttgtcacacccagaagagtgggtattccacaccagacctgcatgatgggctaaagtactaaggcaaacatgttaaaccatgttggcaaacacgttaaacgggtcagaaccaaggacagcacccatgacactagctattagtacctattattataatatttccctccaagctagcactgatgccgcatcaatatgcccagggcacccacactgcgacatccggtctgtagtcatctatatgtgccattgcccagtccatatctctctattctgtcctcggaggtatttggaaaaatcagcagatgatgatattaccatctatttacatcattcttcagacctacctactagcctggtaactttatccaaaaaggaaataaggtgaggagggtatggctgctttcatgttcccgtgctggggtttactacataaagttgtattgcaatttttcacttacatgttgacactagctgcttggtaacccttttaaacatatctagttcatgttcattatagaaaatttataaagtgtagatgagcaaaaatttttaaatccctaaaccccatttcccagagaagggaaccacttttcacattctgtatacatccttctaggtttacacaaccatacacaatcttttcagaggctgattagcctttgaaactcatctaagaattctgctaaagcacaacatcaaatttaatagctaaatcccccaaaaacaccttctccagttcttaaaaccaggaagtctgctcatcaatcatctctggtgctatcatgcaagactaccatgtgcaactgtacaagctgtacagggcacaattgtacccaatagttctgcatactgattttcaattgcttcacaatgttctacaatttgaaaaatcacaaccacaggttttgccactatccaggcatacaatgtatttaggcctacttgtctataggagctatgtgattgctaaatatcttcacatctttctcaaacacaactttgctaacctttgttttaaagccattattcttgggttggggggatggtgggattaggttaatgggagtgaaaatatgttgtttctttctattatcactatactatctattctaagcacactatcccttcatcctttataatctggctccaaatagttaattattttgttttcaactctttcaatttacttcaacattttggacaatttaacattatttggagtttggtcttcttggtaccattctcaaaggtttcacagggactcactctatcacccaagttggagtacagtggcacaatcatggctcactgccacctcaaactcctgggttcaagcaatcctcccacctcaacctcccaagtaactaggactacaggcacatgcctccacacccagctaatttttttttatcatttgtagagatgaggtctcactatattgcccggggtggtctccaactcctgggctcaagcaatcctcctgccttggtcttgaaagtgctgggattacaggcgtgagccactgcgcctggctgcctttcttccatcttctatgtttacttaaaatcagggaaatccaaggataatcacgtggggttctgcttgtgcctctccatcactaggattgacaaattattcatcagaatttcaaactgcagaatccgtcagccttcttttatcacatttttgttcagtctctagccgtggactaacagacttagctctttcaatctttctaacgctggggtacttatctatcttccttttctgatttctacacttaatattagaacatagctaattacagcatctcactctgttgcccaggctggagtacagtgacatgatcatggctcactacagccttgaccttccagaatcaagtgatcctcctgcctcagcctccctagtagctgagactacaagtatgcactaccatgccaggctaattttttttaaaaaaaattttagtagagacaggatctcactatgttgcccaggctgagaacatagccacttttaaagtaatgtaaacttcacatcattaacccaaatcctcctaactggttataaacacatctcaaactaattcctctctagaaccctctgctctctgaaaggtgaaacaaatggcaagacaaggatgcattaggggctgcatggtggctcacacctgtaatcctagaactttgggaggccaagatgggcagatcgcttgagtccaggagtttgagaccagcctggacagcatggcaaaactccatctctactaaatatacaaaaattagccatggtggcacacgcctgtaatcccagctacttggcaggatgaggcgcgcgagaaccacttgaacctaggaggtggcggttgcagtaagtggagatcatgccactgcactctagcctgggttacagtgcaagactctgtctttttttaaaaaaaataaaaaataaaaagaatgcattagatactcgccttttcaaacctcaaaggctgcaacatccccatcatctgtgacgggaaagcagcacccaaaccttcaacctatctgggtggtctataagcctgtgtggttgtatctgactcaactcagggttactgattttcaaaacaacagcaaaaagaaaagatccccccaatcttctcctgacctacaaaatcagaatctctagacggtaaggcccaggaatctgggtgtggtttttttgttgttgttgttgtttttggaaacagattctcactctgtcgccagtatggagtgcagtggtgggatctcagctcactgcaacctccacctcctgggttcaagcgattctcctgcctcagcctcccgagtagctgggactacaggcgcacaccaccatgcccaggtaatttttgtatttttagtacagatggggtttcaccatgttggccaggatggtcttgatctcttgacctcatgatccacccaactcggcctcccaaagtgctgggattacaggtgtgagccaccgtgcccagccaggaatctgtatttttaagaagtgccactagataatgctgaagtattaggaactattggtttatagcaatgatatcccttttagtcctctttgattcccccatcaattgctcacaactaggctatcatgagtttttacagaaataaatcccttactaatacttatttcttcctctttcaaatgccatcagtccaattaagcaacatctcagtgatatctatgagatttgacctatttcctttgtctgatactttaaatgcatttcctccttctatgaggcagcatgttttagtcttgtgaaaaacacactgcctgaaagtcagaaaaactaggttgcatctcagttctgtcaactgctagttgtgtgaccttaagcagatcagttttccttttaggatctcagtcttccataatatcagaatgatattaaatgtctgaaataaattacatcatataatcttcacaataaccttctgagataggtactctacataccctcattttacatagagggaacctcccagtcttgctgcgaaagtttaaaaaacagcatacgtaaagagctaggtaaataagaagttcactcaagaaatatcagtctttgttctactctcccccaaatcctctcagcagatatcaatggacaaggccgatacacaatattcttcttgttaccttctgcagaaaaaatactacgcatctcctccagcaaaaagctaacccccccccctttattttcttggtataagtctcatggccccttaaatgttttgagaagaacaggaatcacacaatctctattcaggtaccttagagtggccaccctcaggagccatgcagagcatgtaactttctggtttcaagcctattcaggacaaagaggttactgaataaggtggtccatttgcctgggctaaaaagtgctttgaggtgttaaaactaagcattttctgaagtacctatgtctggctctcattactctatcatgctgagactcccccatctctcaccaccaccccctcttcctaaggcaacaagaggacacattacagcctcagaaaattgaggccataatacttcgcacacagtgctgaagacatgctgctgttgttaattacaggaaccagatgaaagtctggaaaaacttcaataataaattaaaacaattaaaaggcacaaatttcaaagctcaatatgtaaataacactgtatcaaaactcaaatgtcaattaaatgcccttgactacaaccagttttaacacagctgcttagatcatacaattacagaaacttttattattttagaaatgcatttcaaagagcagctgcaaagaaacttcctttcccacccacccgtgttatcccttccccctccctagtcacaaatctagttgtaaaatctgaagttctaaacgttttaaaagaaaacaatgcaattgctaacagcaacagtccctcaacggatgcctttcacttggaaaacaccaacctaaggtttcagacagaaatgaagtgaaaagaagctcaggtcacaaagtctaacatcttttttccataaaacacccaggaaacaaaacaacaaagtgacagacacctatatgatgtcagaatgaatcaattcgggaatcagtgggtgaataattaaaatttcctaccaataaatcttactacctctggagaagcaggtgtttcctgcctctctgggctttttcttaagctgccatcctcagagtacccaatagatgccaggcatattataacatattatcattaatcctcacacaatacccataaagtattactattattcccacacagaggaggaaactgaggctccagaaagtgggaccacacagctgtaaagtgtaagggctaggattcaaaccaagggcctgtgtgactccagcacccatgctttttcctgtcacgctgctctggccgtgtacccatcctaaagccttatctacgctctgtttcttccacatctcctgggacttttaatctaatctctgtcacatttatggtccataatggcttatcatcctttcttggggataagacaattgaataaaccagggccagacagccaagtgtttcaaaactcttaattgcttagacacctcaacaaaccgatcaccaatgcttatcatcctttttgaagtacaatctgtccctactttacatggtatgaattttcccattaacaacagttcttacaaaccgcaaactcagcctgcagaaattgacattgcagactaaacatttactatgatttttagaaaggcatatcataattatcactttttccactgagccaaaaggagccagagaccacaaacattttccattttccctatactgacaggtatgatattcacagcaagcatttaaaagctataattataatttttacagaattaatggttttcacaatcaaatgaagtcgtaagttgactgtcaatttcaatagtgtaaaaacctcaaactcaagatgatgtacagtaaaaatgaaacaccaaactagtataatgattcataagttgctccacacattattaaatctaagtatgaacatggacacagacctgtttctcctgtgatgctcttaaagcagagtctgtgttaaggaactaatgccatgtttaatctaggtctactagatactaactaacacaatcaacttggccagctcgtcctcagctattagattcatatgtatgatatacactgacatatgtatatatgttcagatcaagtcctgttaaaacaaatagcattttaactaaagtatttccatgtcccagccaatggtccattcatttcatgtaatattcaataccacaaaattccactttaacagagatatggacaatgccttaacattcgctgtaatgaaaactgaattgtatgcaattatactaaccatatttatatacataacacatgttcatctgttctgcttcttctccaaggctgtatactccctaagagatggggttgcctctgaactatactctgaaaaatcaagagaacttcaacagtgccaccttgtggctactctgcaaatacaaggtgagttccctggccctctaaaacgtttgagaagcaaattacagggaagaaaataaaaccaaaacggtggaaaacaaacaataaattgaattgcttgagaaaaatgaaggcatcctctcatcagttaaaatcacttatgagggacaaatacaatcaccaacttaaaaaaagactctgtcttttcttggtgtgagatgcagtctgattctataggtttctgggtttgagttctgcacatacagagaagctgcatcatatgtacatgcctcatcttacttccattcacctgtaattctctctcacgcaatcaaaagcatgtctccatctccccctccctggatccctccctcataattaaaagtgagaattattgaactgagttgtaatccttacattcagtacttggggccaatttaaggaattttccttagccgttgtactaatttttgaaccaacccctaccatcattcacatcaccaccactataatcaagatgtgtgattctgggcatctcacccaattaacttctccttggcttcctaatctacacaatgaaaaacaggactaagtgatggctaagatccccttcagcaattaaatagtatgattctagaaagagaggatttacgttttgctttcctagagattctaatggaagaaatgagcaagtcatgctagatttcagcataaaaagaacggcagtgtcaaatttttctaagctaactctcaaatatccttaaaactcccattgtagaaggtaaacttacacgttttggaagagagattagaaatcagaagctggtttgtcaatttgcagcctcaggtttcaggcctgaggcctgagcctgggtcttgtttgctgtggaagtacttagaacatgagtcttgtttgctgtggaagtacttagaacacggagtcctgatgttctataaatcacagataggctaagggaggagctactctttaagaagctatcctgtagctctgacaagggctagggttgtggtaatggtactggctcatccctggctacttctaggcttattttgacatggcaattttaaccacacactacactggccacatcagaggaaaacattctggccagcattctctataggagtgaaatctctatatcttacctagccaaatttaaattgagaattttttaaaaaacaatatagaaacagaaaaaaattcatgattaatcatattcaaaggggagttcagcacagtggtgcatgcctgtagtaccagctactcaggaggctgaggtaggagtatcacttgagcccaggagctcaaggccagcctggcccacacagcaagatgccacctcgttgagaaaaacaaaaaggtggtacagaacacagcaaattttaaattattttttaaaaatcaaagggaaataaataggtggagcacagtgaaaccattctgtaggagactcttaaggcagatatatgtcattagacatttgaccaaacccacaaaatgaataacagcaagagtaaaccctaatgtaacctatgaatttggggtaataatgatgtgtcagcttaggttcatgaattgtaacaaatgtactgctctgctgtgcaatgctgatagtggggcaggctgagggaacgggttatgtgaatatgggaattctctgcattttcccttcaattttgatctgaacctcaaactgctctaaaaatataaagtctacttttaaaaatcaaagtaaatttaaccagatgtgtgtgtgtgtgtgtgtgtgcacgtgcgcgcgtgcatgtacacacctatgtgtgtatgagacatatatgggaagacagtagtgagggagaggatgcagaaacagcttttgagaaatataataaagacatgctaccagttttcccaatgtatttttgccattccttaagtgccacttcagatacaaatgaatgccctaaacttttgggacacttcccaaacatacaaactatgtttgaagggaaaagagtaccagtttttttaaaattacatacaaaggcaaagtgcagactctaaactacatcaaaataaaaagcatatcattaactcattcaacagaccaaatgaagcaacagttatgaccaataatgaacactttttttttttttttttttttgagacagagtctcgctcttgttacccaggctggagtgcagtggtatgatctcggctcactgcaacctccacctcctgggttcaagctatcctcccacctcaccctcctgagtagctgggattacagacatctgccaccacccccggctaatttttgtacttttagtaaagacagggtttcaccatgttggccaggctggtatcaaacttctgacctcaagtgatccacctgccttagcctcccaaagtgctgggattacagctgttaagctactgcgcctggccaggaatgaacattattaaagatactgcctatatttcctagatagatactaaattataattcctcgagttccatatattaaagtatgcgtcccaaagaaatgctgcctcacacagtactcattcaatcatttcataaatatccacctaggtccttgggccgggcattcttcaactgctcagcttttgaaaagacaagtacagttacctggtaaagcggtaataaagtcccgctgcaacatgggcttcaggtaagagttaatatgtccatgctgataatgacacattcgtgaaataagatgttccacaaattccacttgatctgattcagaccactggtcaaaatatttaatacacaagtctttttctttttgatagtttccttctgatggcctctttctggagacgatcacagatgatgttccattacttatctattttagaaaaacaaaaaaaaaattagtttaacaaggaaagaaacctaattaatatttcattagaaatatttttcaccctgtgtatttaatcttaaaatgccacttttaccctaaagccaaactcattcctttactaattcattcaggaattaaaaatgtattcagggtctgtgtcctcaaattagtcactacaggaaatgccaaaattgtagctatttctaaaaggcaccttaaattatcattttccaatgcttactacaaaatgatgctccaaaggtatatactgggtatctctatacacgggatatatatgaattatcatctccaaagatagctaatgctggagataaccatcttagagaaactgctcaacttggcaaagtggcaactgattattaacagtttgttttacttcctcaaagttcaaagttaatgctacatacatttatgctaatggttctcaaacttgagctagcatcagaataacaggagggattgttaaacacacagattgctgggtcccaccctagaggtttcggttttattagtctggagtggagcccatgaatttctatttctaacaagtttcccagcaatgctgatgccacccgtccagagactacactttagggaccacatgttgagaaccacaggtctatataacaaagataagctgtgttgtgttgaaacctgaaagcaattcaatccaaaaagcttcattttacccaacagtttcaatctcctccatactttcccagggctactaatctggcagaacggtttagactttcccatccttcttttgattaccttctcagaaagtgacccaaggtaaataaaccatgtatacctgaaaagctctgcatcttacgtaggtggtttatggacaactcacagactcttatactaacaatgcatttctcatcaaatcttcctacaagtccttacataaaatcagtacatattttttaaaactgaaactacatacactgcatctggacagtaacattaaaaataatctcaatcactagactcaaaccacaactactatgaagtgcagtaacctccctgtctaaaaacaaaataacctcaatacttttgtcaaacatttgtcaagctatctattgaccactattctgacagcctcctcatacataataccagaaaaaataacacaaaagataattctaagaactgaagagctgaattacaaatacctattaattccgttaggaacttatctcaggagtcttacatggaatgaaccaagagctttcactatcagtatgtcccctaacttaaagtggactaaatccatcccagagaaaacatcctttataaatatccaaaggagtcttcagttttccttcacacaaaatcttgtctgaagttcttatgtccatatttagaggtatgagatgggaaggcatctatcttccactcaatttatcctagcgccccactgtcgaggaatgtttcttcccttgtatcttgggtgaggaaaagctcactgacaccaggtaccaccagggggaagcattgaacaaggattttgaaattttgcttttactaagacatttgagtcttaacagatccaaaaaataagagttcaaaacagagatgaaaagtctttgctgtgatgaatattggcaagaataaggggcatctaagttgctttaagcataagaatgtccaccacaatataacaaggaaaagttagaaataactgcccaattacaggcaactatttaaaacaaattctaactcatcaccattaagagctataatgtaagccactaaaactagcatataaagtaagattttggccaggcatggtggctcatgcctgtaatcccagcactttgggaggccaagttggctggatcacttaaggtcaggagttcgagaccactctggccaacatggtgaaaccctgtctctactaaaaatacaaaaagaattagccaggcatagtggtgggcgcctgtaatcccagctactcaggaggctgaggcaggagaaatgcttgaacctgggaggcggagggtgcagtgagctgagattgcaccactgcactccagcctggggtgcacagcaagactgcgtcaaaaaaaaaaaaaagtaatatttttatagcaacagaacatgcttatgaaataatatcaagaaacaaaaggcaagatccaggattttataaaacattatgatcacagtaattcatgacaaggggaacacaccatgacagagtaaaggatatacatcaaaatctcaaaagtgccttatcttaagaaaaaaaactatgtatgctttccttccccctttatttctatatttgattccaaataacttgccaaaataatggttcataacaggttaaatataatgataacaacttgcatttgtgtactgctttataatttacaaagtactttcacagccattaattcatttgataaacaaaagtgttattttatttacagataagttcctaatcatctggcctccctagagtgtttgtataactattaactagttgactgaaagataaatgaaagaaaaactgaaagctaaagtgtgaagaaccactgccaattgaaaaatcatagtaaatgaagagcatcccactgcaaaataataaacgtggagggtacaaaactcagtctgtacacagtgttaagaagaaaataacagcatgtgcactattctatagcacattttcaatatgctatttccagccacgtgctcagcccagcaagctcttcctagcattgtttttctttgcttcatttcctcttaaatgtgttggatgcactttgttcctgctaactaatctatcttttcagtttcaaatcaaatgaacccagagaatttatttttacattattatcttcagatttagatttgttttgcttttaatcctgtcttcatgaaggggaaagccatgtgtaccagcatggttgataaaccaccaaatcgtgaaactttgcttgctccccaaacccccaaccacacacacatacacacacacacacacacacacacacacacacacacacacacacacacacacacacaacctgggaaattgggaagaaaactggcaaaccttaaactagagccaagggagaaggagacaagcttaaaaggaaaaggcaaaccaatggaaatgggagagaagagtaaaggttgagagcaaaaggagaaaaggtcatccatgtatacactggtgtgtggcatggtgccattctggtgacaaaggatgccatcactgtccatctttggcttaggcagaggccacagacagaacattttaggctacagccaacttcagaatctttgtggaaactccaaaattatttagcatatttgtaatgacaattccctatggaatgaagataaattagggtggattctgaaactagcaaaactgcacaaaagaaaacaaaatgcttggctcttgattccactgaggacattaactgagggagcatcctatctacagtaagtcagttgctatctaatctgtgcgccgtcattcctacctgccaaagagtatttttctttggggactcatcttcattttgatcttccataactgaagtgttctagggggggaaaaacaggttatttgaattataccaagttttgcaaatcctaaataactacaataaataattttgaaaacccaaactagagtgtaccaatacaaacccaagaactatttggctttgtggctaacacatgccattttgggtcaagggagatgtgctcatctttcataaatcgataaagttagtggttagacaaaagcaagcataaagtcattatttacaaaggttgggtgtgcttagaaaaaaaggctaaattgtgggagtaaggctgaggctcaacctccgtcatcactgtttttgtacttgtgacaagaaattccaaagacccatgaggtttccgatgattgcacaaaacatttactagaaggtctgctattcagtaatgcaccccaaggaatccgcaattagaagtagcaaagccttggaagcccccctgccttcgtctttcctcccctgatagccttgtttttctggaatggctttgcaatctctgctagcaagcatagcgggtgccccaaccttctccctgaagaggaggatgctgttagccagtaacaatctggcttgccttgggaatgcattagcttttgatttttgtgcttactgcacaaagaggtactgtgtaattattctttctggtgatccagtcgctcaatagatgcccattaactagagattatacatgattggattttcccttttgaagctcccacctaatggctaaatggaaacttaatgagaaggggaagtgggctagttgtgctctgaaaagagtaacaactcatttatggatagcagtctctctaaattccttccaaaacctaaaattataagactggggtataaaatttaaacaacatttgtctcatagtattattcaaaaggatattatagatctatttaaggtatcagtgttttacaagatcctgtttgttgtctttagggaataagcctctctcaaattttccctatttttcctttatgttctacaagtcctaaaatgtttggactatttatacagtatttccaaacaatccatttgaaaataccaatgtaggtaatgatgtaagaatcaccactgaacactagctgctctacaggtcacaaaactggctctgatcaggaatgcagtatgatggagtaggaaagtcaaaggctttgaagccaaagagaagttggattcctgatttggtcactcattctgtgtgtgtgtgtgtgtgtgtgtgtgtgtgtgtgtgtgagcctgagcaagttcttttaccatgggaacaaatacaaacacacagagttgttgtggggatggagactgccctacacaatgcttagtgcataatgggtattccaaaaaacattacttcactctccgatttgaagatgctacttttcactgtggcattattcacaacagcaaagacttggaaccaacccaaatgtccatcaatgatagactagattaagaaaatgtggcacatacacaccacggaatactatgcagccataaagaaggatgagttcatgtcctttgtagggacatggatgaagctggaaaccatcattctcagcaaactatcgcaaggacaaaaaaacaaacactgcatgttctcactcataggtaggaattgaacaatgagaacactggagacacaggaaggggaacatcacacactggggcctgtcgtggggtggggggaggtggggggatagcattaggagatatacctaatgtaaatgacgagttaatgggtggagcataccaacatggcacatgtatacatatgtaacaaacctgcacattgtgcacatgtaccctagaacttaaagtataatttaaaaaaaaaatgagaaaaaaaaaaaaaaagatgctacttttcccctgtgttatcttcttatgcttttctaatttcagagattttgacaggatgctccagatggccgcctatggggaaaacctgactttctcagtaaaatcttataaaccccacagcatcaaggtccacaatgagggagagggacaggagggtggggctctatgtgaaaatcaaccatgagctagagaggaaggcagtgtgtccaagagtccaaaacaggactggagtggtgaaagcagtaagtaattctgaatgggatgaagaacaaggaaacaaaggtagtatttatggaggtctctccatgtaatcttttcattgctatcttgaagggacctaagagtttaaagcaagcaggtttcctcaggggaataaagaaagggggagcagtgactcagtacagcatcccctgagtttggtagttacaaagccgtcttgcaaggccacaatgtctgggttctaagagtggtaaggagaacaaatggctggaaacatgaaaggtggagcacggaaaggaatgaggaattaagtggaagagagatgggaagtcagtccccaccccatgtctccaggtactgcagaggaaacatatgagggatgtatatatggttttgttttgttttctgttttttgtggggtttttttgttttgttttgttttttaaatacggagtcttgctctgtcgccaggctggagtgcaacggtgtgatctcaaatcactgcaacttccacctcccggcttcaagcgattctcccgcctcagcctcccaagtagctgggactacgggcacacaccaccatgcccagctaatttttgtatttttagtagagacagggtttcaccatgttggccaggatggtctcgatctcttgaactcgtgatctgcccgcctcagcctcccacagtgttgggattacaggcatgagccactgcacccagccaagagatgtatatatgttttaaactaaaagcttttgaaatataggagccagaatcctccagagctattgtgacctaaaccaccttaatattttctttacttaagatggaaacacaagaaatgtcagacttccctgtacactatacatgaaacaactcttcacagtgagaaaatttcactcttcatttattccaaaacagagaaatgatgtttacttatatggttgataaggaaacaaccccctgaagaaaatagcagctattgccttaaggcttcataaagaaggctagacatacaatttaataaaattgtttttaataaaaccatgggggctgcaatagttctcccatcctacatacttttccacttcttttataaaggtttcagaagacaccaaagggaaaatgctgctctcaagttacactgaccagaggatccagaggattccaggcaatgcaaaagatgtctggagaaaaaagcatccaagagtctaattaggtttagaaattagagaaatgctatacacatccttgcactctagactcactctgtgtgtgtgtgtgtgtgtgtgtgtgtgtgtgtaaatatatatattcaattcagagatatattttatatatatgtctctcagaagttacaatacactccattaagatacaaaaggttctataatatactattattttaaaattaggttaaattcatttaatccaactttcccaagtttgttggacatggacagcccccattttataataatatctattaataatagctcagcacatattggcaaacactggactagagcaacagcctggcgtaattccttcctctctcttcaccaaatacttttgggagacaaaggaaacacccactttgttaaatacaatacagtcctctcctattccccatcatctttctcagcctgctacaggttgagcatcccacatgcaaaaatcctaattccaaaagtataatacagatattctaaaatctgtacatttccaaaatcagaaacacttttggtcccaagcagataagggatactcaatccgtacacagggtcgcaggaataagtggtgatggcaaaaatagaaaattctcttatggaagctataatttttttaatcactttgaattttattccttaaaggcaagagacaaaaggtcacaggttcaagggtgaggtaagaaaaaacaatgagcttcccaagagaaaagaaaggtcatttcctatatccaaactctcatgtgaaaccatggccaatctgagagttgaaatcctctttaagtctccaacacttatgagaaggaaaagttatttgaaataccaaccagtttactttctacccttctcatcatttccttcctcttatgtctaccaaggagcatcacacgtaaatagattacaatgcagaccctcctattattctgatactactaccaatcaaagatataacctaggaagaagaagctagactctcaggcagatcaattttagtactattaccattttgagatggatatttctttgttgtggggctgctgtgtgcattatagaaggttagcagcatccttggccagtgcctgtgccaggagcattccacaccctctgaactgtgagaatcaaaaatgtctccagatcgccaaatgtcccagggaagggggctaaatcactctctccacttgaaaaccagtgctctagggatgtgggctcctaaacttgacaccgtgggagaatatactaaggcactaccatctcaggcctggcccttctttctccttagccatctttccttggcccgtgtgacagtctgtgatgctattcacatacatcctgacctcgccatggtagggtaattcacgaagtatgttgatatctaaattcagggctacgtcctgcttgccattaaattcatatttggaaaaccatggttatcagtggttctttactagaggtccatggacttggggcatgaatgaggactataaataacaggaagccatatatatacagctgatcatggagcagatggagcctaggcatacgttttcctttcaagttctccaagtaattctgatctatctctgctcaaaaatcattgctatggcaaaatgatgcagcccatgtggtagcaccaacctaagtaaggaagctgcactgatggtatcatgacagactccatcccaatatgtgatatttcataactaccaaataccacaatactctaacgcctgttcctgggtgtcttttacaaggaaaaattatgaaaccagtcattcactggatattaaaaacatgaccaactatataccttatcaagtagctccaaagaagaatagagaaaataattgttatttaatgattgcctatgatggtcaggcattgtgatagaaactttatataaattacctttaatgatgaccttgtatgatagcacctatatcctgttttacacattgggggaaccatagctcagaaatgttacacaacttgccttgggttacacatcaaaaagtaccaagattcaaagctagactctgtaagacactaccttcccagttagactgcatatatattatagctatttgcagcacaatgaagatcctaatcttgtttcaaagacactcttcccaccatcacaaagaaaacacaggctgggcgcagtggctcatgcctgtaatcccagcactttgggaggctgaagtgggcggatcacttgaagccaggagttcgagaccatcctggccaacatggtgaaaccccatctctactaaaaatacaaaaattagccaggcatggtggcacatgcctgtagtctcagctacttgctacttgggaggctgaggcagaagaatctcttgaacccaggaggcagaggttgcagtgagcgaagatcgcaccactgcactccagtctgggcaacagagcgagactctgtctcaaaaaacaaaaaaaaagaaaagaagagaaaacacaggcacagttactctgtcttcataaactgaattctgaacataagtggaagtagcgtaagcttccattctagggatgactggtttggatggtgtctggttagttcatttagtcaggtctccattatcctcagagtcagatttggaaacttcatgccaactgatcacagatatgttcggtgaaggaggatgggaagcataatcaaattccacaccgctatttaaaaaaaaaaaaaaaaaaccctgaagggctgggcacagtggatttactcctgtaaatcccagcactttggaggccgagggaggaggactgcctgaggcgaggagtttgagaccatcctgcacaacacagtgagactctatctcttaaaaaaatttaaaaataagccaagcctcgtaactattcaggaggccaaggcaagaggatctcagaagtttgaggcttcaataagctaagatcatgccaatgcactccagcccgggcaacagagcaagcttcatctctataaaaaagcaataatactaataaacaaaataaaaaataactgaaaatacatatagtgtgtttttttaatatgataaacagattagcaaaagtaactttcctttttatctgtgcattttcatgaacatggcgaccccaatgcaaaaagtcttcgccctgggaaacgaatgcattctaggtagccgagatgtaaattacatttctgaaactgaattctatataaaaccaaacaaaacctgagaaagtggaccccattgcatcatcattctaaaacaaacaaacaaaaaaatcccacaatattgtgacttgaaaacttgtcaagatgttttcatcaactgggtaatttagtacagcaatactgtgtctgctatggaatctcagctaccacttagaattcattctttcttcagagcatttcaataatcctagaatctcttctgtacattcccccttctctctttcataccaatcaacggaagtggtaggctggttccaatgacctagcctccagtttcatttagtttatgtataggtacaacaggctcttagcagtgatatatgtttaacataggagccacgaactgacacagaatatatttcaattggaaaactctctactttgagaattatatgaggaatcaatttcctgctttaaaaatgctgcaaattctgcattaagtaattaacagttaagagtcacacagctagtaaatgagagacacaggattcagacctaagcctgttctactcagaaatcaatgtactttccacacagaaaaatgtgtcttaggtgttttccaactgctggttttggcctatgaaatcaatttaatagactgcaagcagaatgttttaataaaacaaagctgaattgagaagatcccctacacacaaaggtaagcaaaataacaaattcatataaaaaagcctaaaagaaatgagcaaaaacatagaaaaattcaaattaaaaggaaagcaagggtctttattgcaaggagagcaatatttacattttaaatctctgaaaagcaagattcaaaaagaagagtgctttttaagagtcagggttccactttgtcacccaggctgaagtacagaggcatgatcatagctcactacaacctcgaactcctgggctcaagcaatcttcccaccttagcctcctgagtagctaggactacaggttcacatcataacacccaactaattttttaaaatttttcagagacagggtcttgctatgttgctcaagctgatctcaaactcccaggctcaagtgatcctcctgtctcagcttcccaagtcactgggattacaggtaagtcaccacaccaagcaacagtacataaaggggaaaagttggaaacaaacaaacaagggagggagggagggagggagggaggggcttgatttactagatatatctcaaactttctacccaataagagactacatattattctcaattttccatggagcattttgtaaaaactgatataggtcacagaagaaaattccaaatatagttagaaatcaggaacagattattacatatttaagattaggccaagtagaaaaatctaaatatattccgccaattattacttgctataaattccaaagataaatacatagaacaatgactggtaaaggcaaaccaaacagcttttcattgttcttgttacctacacgtaggcccctaaaacccaaatcttgccaacacattgctgggaattaaaatcactagaaagccagaagtattcattttgaaaaagaagagataaatttgtctaaaatagcagttcctatctctcaaacaaacaaggcaattcagaaggaagaaggccatatgtgctcatacattaacacaaccaccatcaaacagcttgactggaaatcttctcccctctccggacaaacactaaaatataggaatataccagttattttctttctgccatctcataaaaatgtaaaccactaataaattttaaatccattaggagtttggttgaaatttgttatatggattattataatacagtaagttctcttctaattaatctaaactgtagttccactcaaatttgtaacaagtatttcattgttattgacattatacgacaagaaatgataccaaaaataccttaaagaatgaatgtggacgaatgtttttcttctttttgtcatcaccaatcgtgtgtgtgcgtgtgtgtgtgtgtgcgtgtgtgtgtgtgacagagtcatgctctgctgcccaggctagagtgcagtggcacaatcccagctcactgcaacctctgcctccgcggttcaagcaatactcgtgcctcagcctcccatgtagctgggactacaggcgtgcaccaccatgcccggctaattttgtatttttaatagagatggggtttcgtcatgttggccaggctagtctcgaactcctggcctcaaatgatctgcccgcctcagcctcccaaagtgctgggattacaggctgagtcaccacacccagcctggataacaaagcttttaatcaatttttagttagactttttcttactgatttctagaaattctatatatattctagaatgaactcctttctcaaatatattattacaaaggtcttctctcaatctgtggcttaacttttcattctcttaatggtgtcttttgataaacagaagtaataaagtttaatgaagtttaatttgtcaattgtttcctttcttatttatgctgtcatcttgctcaagaaatcttttttcttctaacgtcataaagatattcttccacacctaggttttattttaccttgtacattttcatttaaaattcatctttactgatttttaagtaaagcagaaattaagattcatatttttaaattttaagtccatgtttttccaactggagactgcaatccattatagtttaaaatatcaatttaagggataaccagcattttttttaaaactgaaatagaatagagcacatattatatcctctacttcatcaattctaagatgtatttttttttttcacattttaacgtctctgaaatagagatgtttcttataatcaatatcttacaattaaaaatggcggcaattttcctgactatacagacataacacatacacacgtgatagcagcagaaggcagacaaaatcctaggcagacaggggagggtccgcggtgaaaccccaccttttttttttttttttttttttttttttttttttgagacagagtcttgctctgttgcccaggctggagtgctgtggcacgatctcagctcactgcaacctccgcctcctgggttcaagcaattccctgcctcagcctcccgagtagctgggactacaggcacccgccacgacacccaactatttttgtatttttagtagagatggagtttcaccatgttggccaggctggtcttgaactcctgacctcgtgatccacccacatcggcctcccaaagtgctgggattacaggaatgagccactgcacccagccaaaaccccaccttcaagctaaaaacagcctgaagcctgaagacaaggctgctggttctggatgaagcccacgacccagagtgagaatttctattcctgtttgccagctctttcccaattgtttctttctggataatgccttttaatcaaacattgccttttccaatgctacttactgcccgcacctctcccattctgtgactattaaaaaccctgaactcagccacactgggggactatgcccattttgagtgccctctccgctgagaactgttttgtcgctcaataaaactttccgccctgctcaccctctggttgtgagcataacctcattcttcttggatgcgggacaagaactcaggacctaccgaacatgggtaggtaaaacgctgtaatactgtagccctccaccctctgccggtgccaggcagcagccccgcatgacaggaagcagccacggggccaggccagcccaggagccgtgggccagagcagggcgacaggattaaatgagctgtaacataagtgggctgaaacacgtcccacccccccacccccgctgattggtagtgctgcagagaggagagaagagctacaacccttctggggccccagacctcgccactcccagagccagagttgcgacatgctgtaacaccctctttggggtcacgcggatgctggtgtctccaaaagtttcaagtgccaccgcattcccccttgtctagatgccggtgcccaaggcagaagcaggctacagcacgcctggccccggcacagactgagtgcgggatcagggccagggcgctaagagcagcccaccaggccaagtgggcaagatacctccaacagcaagcccagggcggagcgcggccctgggcaggggcactgccagctgcaaagtctccagctggcgaagcagcacagaaaacatcctgcatcacatgcatatatataaaaattaccacacacacactaggtataaacataaatttcatttcttacattgaaaacccctgaaaaaccctgctaaaggttagcagagtataataaatcccatactaaaagttactaccttttcagtttgctttcaattctaatttcatcaaaagatattttcacacctctctaatatctgccatcacctgtttttaacaaaaagagccaggctactgttcaattttctgtaaaaaacaaacaaacaaacaaacaaaaaaaacagtatctggctaaaacgtcatatgggtttttggtttttcgttttgttttattttgtttgagacaaagtcttgtcctgtcactcaggctatagtgcagtggcatgatcatggttcactacagcctcagtctcctgagctcaagcaatcttccagcctcagcctcccaagtagctgggaccacaggtgcatgccaccgtgcctggctaatttttttatttttcttttatggagacaagatctcagtatgttgcccaggttggggttttttaatggtatttacttttacactaatctacgccagtaagcaccactgattttccagtcatgtagtgattacagttcccttttctgatttactttacaaagtagatttttaaaacatggtcagcaggtaaaagaacaaatggtgtgcagacatgtcaaaaattgtgaggtttgtactcaaactgcccaaagtcagggaaacactattttagaagaacaatgataggggaaaaggcctaaactattttaagtgggaaaaaagcaagtcacaatatatctgtacaatctcatctttacaaataaaatttattttactatttacaaaagcaaccatgtgcttacaatattatctctgtaatttttatttgatttttgcttacttatcctacctaaattttccttaaagtacacacgtatctttttaacagcaaggaaaagtgattttgaagttaaactttaaaagtaagtaaaagattcacaccaagaccccagatatatatgctgtggtctagggaaacagaaactcttactgaaaggtccagcagtgctgtattccacttgacctctctgtgcctatgtcctcatccacaaaactgaggtgaaaacagggcctccctggcagagtaagtgagaaaattttaagagataatcctggcacccaagcagggctctgacacagtttgcatctgtgtccccacccaaacctcttgtcaaattgtaatccccattgttgaaggtgaggcctggtgggaggtgactgaatcatgggagcggtttctcatggtttaacaccaacccccttggtgctgtcgtggcatgagtgagtgagttctcacgagacctgattgtttaaaagtagcacctcaccactctctcttcctcctgctccggccacacgaagtgcccgcttccccttcgccttctgccataattgaagccaagcagacgctgccatgcttcctatatagcctgcagaaccatgagccaattaaaccccatttccttatcaattacccaatctcaggtatttctttatagcagtgtgagaacagactaatagaggctcctttagtcaaatttaacttccataaggcagagatatttggttgtattattcaatctgtatccttagcacttagaataattcccagcatactacttaagtacagaggtataataaatatctattgataaatattagctacacacttcagtgcagtgggaaaagaatggtcttttaaataaaagactctatcaactagatattcttaacatattttgggccctaccctctcacatgcatacaaagaaatacaaaaaaaaatccattctagatagactgaagatctaagtgtaaaagacaaagcagtaaagcttttagaagaagccataggacatcctcaagacctgggaataggcaaaacttttttaaacaatacacaactgctaaccacaaagaacaatgtaataaatcagactatattaaaataatttctgttcattgaaaacattcagagattgaaaatgcttgaaaactgatttatggtgatgatgcatcactggactacatatgtggattagttttgtgatatgcaaaatataccacaatatacctcaattctttcaaaggaactagatgtagaagaaaaaaggcaacttacagagcaagaaaagagtggcaatacacacagaattttttttaactcacttcaaaccaaggaagaatcacaatcacacacatactaaatttttaaatgagcaaaagacttccacaggcacatcacaaaagaaaatacacaaatgaagtttttttaaaaaggaaaaatcaaccaaaatactgccacctagggatgaccactggaccattttggtacacagactgaaaactgcatatatgtaagtgaaaattgtttaaaacatgctcttcggttaactgttttttccatgtgtcatgcacatctttccacatcattgtagttctacgttttcatttttaagggctacagttcacttcatcccataatttccttactcaatacaagtagtaacaaacattacattttttactattaaacacaacactgtaatgaaccttcatgcctactctgacaattacctcttggtcaaatttagaaatccatgagatccaaaaggatggctgaactgaatttcctttgcgaattccttgactaataatcatttgttttcatcagaaaagacttcatactacaagttattaaatctaagggtcaattcttattcctcctatttcttcaccgatcagcaaggttgagcacttccatcttcttgatatacttcattcacttggcttccaggactctgatctaattctcaaaccttcactacaagaaacgttaaagttcttcagacaaaaagaaaagaaaaattggatatagtaaaggaatgaagacataactgaaaagaaaaatagtaaaaatgagagtgcatatacattaatttcttttctttaaatttatagaaaatatgactaactgaaaagtataaaatattgcagaaaaaatcaaagagacaaataatagaaaacacaattcatgttcatggattgcaagacttaatattaagatcttcgtaccacccaaaactatctacagatttaatgcaatccctaaaaaaacccaacgatgttttttgcgtaagtagcaaaatcaaccataaaattcattagcaatctcaagggactcagaacagacaacataatcttgaaacacaagaattaaactggacttcaatcagctttgaaaagctggtttcaaaatttactacaaagctattgtaaccaaaactgtggaactagcatgaagacatatgtatagaccaacgggacagaatggaagattgtaatcggtgcatttcaagcatttgacaatattcaacatctattcatgcttaaaaacactcagataacttcctcaatatgataaaggtcatataatgaaacatcatcatacttaatgtttaaagatggaacattttccccttgtcctgaaggacaaagctagaatatccattcacacttctagtgtgaattcaaatttgtgaatttgagccgggcacagtggctcacacctgtaatcccagcactttgggaggccaaggcaggcagatcacttgaggtcaggagttcaagaccagcctggccaatgcagtcaacccccgtctctactaaaaatacaaaaattagctgggcatagtggcatgtgcctgtaatcccagctacttgggaagcagaggcaggagaatcacttgaacctgggagatggaggctgcagtgagctgaggtcgtgccactgcactccagcctgggtgacagagcaagctccatctaaaaaaaaaataaaaaataggctgggcagtggctcaagtctgtaatcccagcactttaggaggccaaggtgggtggatcatttgaggtcaggagttcaagaccagcctggcaacatggtaaaaccccatctctactaaaaatatttaaaaaatgagccagtgtggtggcacgcgcctctaattccagctactcaggagctgaggcacaagaatcacttgaaccctcaaggaggaggttacagtgagccaagatcgcaccactgcactacagcctgggtgacagagtgagacctgtctcaaaaaaaaataataataaaccaatcaataatttaaaaaattgaaaattcgtgaacttgaaattgaaaatcacaagtttcactatagtcaatgcaacagagcaagaaaaagaaataaaaacataaataacaaaaagaatgtagatggtatgactgtctaactagaaaatcctgctgaatctacaaaataaaagtgatgggatggccgggcgtggtggctcaggcctgtaatcctagcactttgggaggccgaggtgggcagatcacgaggtcaggagatcgagaccatcctggctaatgtggtgaaaccccatctctactaaaaatacaaaaaaattagccgggcatggtggcaggcgcctgtagtcccagctactcgggaggctgaggcaggagaatggcatgaacccgggaggcggaggttgcagagagccaagatcgcaccactgcgctccagcctaggcgagagagcgagactctgtctcaaaaataaaacataaaaataaaaattaaaaaataaaagtgatgggatattagtgaattcacaggacacaaagactgacaaaaaaaatgaagctacgtaaagctcaagctctcagtataactaaaaggcacagaacataagtagaaatttaaatcctagtacatccttatgctccagccataaatcttcatgaagatcaagggcagttcaggaaaactgtgcagaataaaaaaagaaggaaacgagcagcagataaaagattgacataaaatcacattatgtatgaaaatacttaaaaagcgtcctgctagttcagagttgattacagataaagaggatgcaagatgcaaaaaggcagtcttcaaaagatcagtttttaggagaaaggagtgtacaaacaaaaggcaaatagaggagaatttcctcaacgtgataaagaacacctgcaaaaaacctacagctaacatcatacgtattagtgaaaaagttgacaccttcccactaaaatcaggaacaaggtaagaatgttccctctcaacactggttttcaacatcatcctctaagttctagctaatgcaataagacaaggaaaggaaataaaaaatatacagattgagaagaaagaaaactgttttggttcacaggtgacatgattgtctatgtagaaaaactgaaagaattgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaataaaaaataaaaaataaaaaataaaaaaataaaaaaaaaaaaaagaaaaactgaaagaattaacaaaacagcccctggaactcataagtgattatggcagatctgcagtatacacagtttatatacaaaaagtcaatcactttcctatataccagcaatgagcaaatgaaatgtgaaattaaaaacatattaccatttacataaacacctatagatataattaggtataaatctaacaatatacacaagatatctgtaaggaaaactagaaaatcctgatgaaggaaatcaaagaactaaattaatgaagagatattccatgttcatggaaaggaagattcaataaggtcaagacatcagttcttcccaactggatctatagattcaatacaatctctatcaaaatccagcaagttactttgtggatattgaaatgactctaaggtttacatggagaggctaaaaaaaataaataattcaaaataaataaataataacaaacacaactgaaggagaacaaagttcaaggaatgatactgtctgacttcaaaaggcactacaaaactacagtattcacgaaagtgaaagtgtggtactggcaacagaatacagagctaggtcaatggaatagaactgagggcccacacaatagacccacacaaatacagtcaactcatctttgactgtggagcaaagtcaatacgatgaagagtctcatcaacaaatggacatctatatgcaaaaaaaatgaatctagacactcagcttacacatttcacaaaaattaactgaatacagattacaagcctaaatggaaaatggaaagctctaaaactcctaaaagataacataggagaaaatctagatgatcttaggtttgttgattactttcttagacatatcaaaggcacaatccatgaagaattattaagctggacttcattaaaaataaaaatctctgagagacactgtcaagagaattgaaaaaatatgccacaaactcagagaaaatatttgcaaaaaacatatatgacaaaggactgttatccaaaatacagaaacaatttctctctctctctctcctctctctctctctctctctccctccctccctccctccctccctccctctctctctctctctctctctctctctctctctcacagggtctcactctgtcacccacaatgcagtgcagtgatgcaatcaccactcactgcagcctcaacctcccaggctcaagtgatcctcccacctcagcctccagagtagctgcgaccacaggggtacaccaccatacgtggctaatttttgtatattttgtggagatgaggtcttgccatgttgcccaagctggtctcgaacttctgggctcaactaatccatctgcctcagcctcccaaagtgctgggattataggtgtgagccaccatgcctggcctagaaacaattcttcaaactcaacaagaaaaaagtaaacaacacaatttttaaaatgggccaaaaaccttaacagtcacttcaccagaaaagatatacagatgacaaataaacatggaatatggagcatctcttcataagtcatcaggtaaatacaaattaaaacaaaataccacaacacatctatcagcatggccaaaatccaaaatgcaaacaccatgaaatgctggagaagatgtggagctataggaactctcattcattgctggtagaaatatcaaatagtaaggccactttattttttttaatttgtacaaatttatggggtagatgtgaaattctgttacatgtatataatgtgtagtgatgaagtcaaggtatttagggttcccatcaccaaagtacaacacatttttgtaactatattcaccctactctggtgcagtcactttggaagacaatttggcagtttcttacaaaactatatatactcttgcccaacaatctaatattcatcctcttttttacttgtccaaatgaagtgaaaactaatatccacagaaaaaccttaacatggctgtttatagcagcagttacacataactgctaaaacttggaagcagccaaaatgttcttcaataggtgaatgaataaactgtggtagggccaggcacagtggctcatgcatgtaatcccagcactttgggaggccaaggcaggagactctccagcccaggacttgagaccagactgaacaacatagggagactctgcctctaccaaaaaaaaaaaaaaaaaaaaaaaaaatttagtcaggcaaggtagaatgcacctgttgttccagctacttgtgaggctgaggtgggaggattgcttaagcccaggaggttgaggcttcagtgagccacaatcacaccattgcactccagcctgggaaacaaagcaagaccttctctcaaaaaaaaaaaaaaaaaaaaaaaagtgtggtacatccagacaattgaatgtcatccaatgaaatgaggcatcaagtcatcaaaaaacctggtggaaacttaaacatctattattaagtgaaagaagccaatatgaaaaggctacacaccgtgtgatccaactagatgacattctgggaaaggcaaaactatggagacattaaaacaattagtgattgtcaggaaggatggataggaagcacacatagaattcttagggcagtgaaactattctgtatgatactgcaatgatggaaacatgttattatatctgtccaaacccaaagaatgtacaacaccaagaataaatcctaatataagctatggacttcgggtgataatggtgtgtcaaggtaggctcatccattgcatcaaatgtatccctgtggtatgggatgcccacattgtaagaggttgtgtgtgtatgtgggtagaagggatcctagaatcccaggaggaagtattctaggatcctgcaagaaaagaatttttaataacatccaaaggatacaaagcctttcctcccaccatcacctgcttatcctgcaaaggaagccatgcagtaaagaaataatactttgataaggaatgctcttaagctaggaatcttatcaacttaaactacctcaaactgccaggtctgtctcaaaaaaatgtagagacacatgcaattttcatctatttaaaaaaaaaactatacagggaaaagttcattaaactcctacatataaaagaagaggcagggagtaagggaaggagggaaaaacagagagaactaaacaacatcccaaacaagcctttcttaactaaggttctgtgagatcatgaagcccttatgagagtaattttgcagacagttttcttaatttccctaaggatggtacatagataataccattcctgtcatgtatgagagacattaattcactatatacaatgtatgccttagtgcgtaagcgcatactgtttttgagaaacctggttgaaaagagctactgcaaactgatttaaatatgatcaaacaggcatgtgatgttacttaaaaacactctgaaacactgaatcagaaattgaaaacttaagacagaaatgtaccaaaaaccagaagaaatgtaataagaattgacctaactcaaaaaataaaaacaaaattataacaaacaagaatacattaaaatacccccaaaacagataaagcaaatgaaaattttaaaaatttgaaaagtaggttgggcacattgcctcatgccttgtaatcccagcactttgggggccgaggcatgcagatcacttgaggccagggttcaagaccagcctgggtaaaatggtgaaaccccaactccactaaaaatacaaaaattagccaggtgtggtggtgcacacctgaagttacagctacttgggaggctgaggcacaagaattgcttgaacccgggaggcagaggttgcagcgagccaagatagcgccaccctactccagcctgggtgacagagtgtgaccctgtctcaaaaaaaaaaaaaaaaaatagaaaattattaggaaacattgaagacaagcaagaaaacaacccaagagaataaaaatgagatgaagaaataagcaatatgggcagtgagaaagtagttaacatggaaaacaaaggagatccaacctaaatataattggagtttctaaagaaaaaaataaaataaaaataacctttaaaactataatccaagcggttcctagggttggatgggtgagggatatagggaatgacagcctaagggtacagtggttttttttgtttgttttttgttttgtttttgagacggagtctcgctctgtagcccaggctggagtgctgtggcttgatctcactgcaagctccgcctcctgggttcatgctattctcccgcctcagactcccgagcagctgggactacaggcgcctgccaccacgcctggctaattttgtttttgtatttttagtagagacggggtttcaccgtgttagccaggacggtcttgatctcctgacctcgtgatctgcccacctcggcctcccaaagtgctgggattacaggcgtgagccaccgcgcccagccggtagcgtgtttcttttggtggtgatacaaatgttctaaactgactgtggcactggttatacaactctgtgactatactaaaaatcactgaattgtacactttaaatgtgtaaatttacaatatttgagttatgtctcaataaagctgttatttaaaaagaaaaaaaaacgataattcaaaaagctttccagagataaaaggaaacctgaactacatgttgaaaggggctccaggtaataggggaaactggcccacagcaataaactccaagagatatcctaagacaattgttagactttaaaaataaagaaaaaatgttttcaatccccaccccaaattttttttttaatttaagaagaaacctttaaagagaaagagcattaattggattggcatcaaacttctcgaaacaacacaccaagcaaggcatcagtggagcagcatcttccaaaattttagaaaataaagggtaaaggtttccttgagtaatcctgagatgatgcaaaaaattgtcaaaaaaattaatggtaaacatttaaaacaattatggctctaagaataaacaagtctgagccaggtgttgtggctcgcacctgtaatctcagcactttgggaggccaaggcgggctgatcacctgaggtcaggagttcgagacaagcctgaccaatatggtgaacccccatctctactaaaaatacaaaaattagccaggcatggtggcgggtgcctgtagtcccagctactcgggaggctgagataggagaactgcttgaacctgggaggcagaggttgcagtgagccaagattgtgccactgcactctagcctgggcagcagagctagactccatctaaaaaaaaaaaaaaaaaaaaaaagaataaaacaagtctgaagataacagaagaatcacatgtcatattcagacaaagaaataacacaactttaaaactgcaggccaggtgcagtagctcatgcctgtaatcccaacactttgggaaggcaagatgggaggatcccatgagccaaggagttcaagaccagctaggcaacacagcaagacccatctcttaaaaaaatttaaaaattagccagatgtggtagcccgcacctgtagtcccagtgacttggtaggctgaggcgggcggccccaatcacttgagcccaggagtttgaggctacactgaattatgatcatgctactgcactccagcctgggcaacatagtgagagcctgtctcaccaaaaaaaaaaaaaaaaacaggaaatagaggcattacaaaaattataattaaaactaacaaaaatacaaacctctctataaaaagaaatttcaaaaataaaagagcaaagaaagcacatcatgaacagaaacaaactaaaagaaatgcagagagacatggatataaatacactatacacactactctcactacaagacagctcaagaaaacaaaaaataaaaattcataagcatcagtaaggcaggcaggtcttacaggatatgataacctgtttacacagactaaacttgcttttccagcacgtgtaaaaaatttctgaaagcttatcatatattagatcacaaagaaataagttcaataaaaaagaaaaattagaaaataagagcctctgatcaaaagataataaaactaaaagcaattcctagaaaaagaagaacaattccttcaatcaatgttatggaacaatttatagagcttctggcccatttgttctttaaaggtctggtggaattctctgtgaatccacactgacctgatacatttttctgatttaattctttgacaggtttctctattcttttcttcataactattgttggataagagaactcaacattcgaaagatgacagttctccctaatttataagtttaacatttccccaataaccccacaagaaaattctttatggagctagacaaaatgatactcaagttcatattcaaaagcaaacttacatgagtattcagtaaaaaatacaaaaaaagaaaagtggggaatcagtcctaccagacatcaaaatacaccataaataagcctctctactgaaaagcaagatactttcatagcacatgaatacacaaatactccagagtagggttggcaagctttttctgtaaagggtcagatgtaaatattttgagctttgcaggactcactgattttgtcacaactactcaactcttctgttataggatgaaagcagccacagatgatatgtaagtgaatgagtgtggctgtgctccaataaaactttatttataaaaacgcagtgggggccggatacagtggctcacacctgtaatcccagcattttgggaggccaaaatcattgagctcaggagttcaagaccagcctgatcaacatggtgaaaccccgcctctactaaaaaatacaaaaattagccaggcatggtggcacacgcctgtagtcccagctacacagggggctgaggtaagaggatcacttgaacctgggaggttgaagctgcagtgaaccatgattgtgccactgtactccaacttaggtgagagaatgagaccttggctcaaaaaaaagcaaaaaaaaaaaaaaaaggaaaatttaaactagataaaaattttaaacttttgcacagcatttttattaactaccataaactaaaccttaaatgacaaactggaaaaaaaatttgcagcctatgtcacaaataaaagaactaatatccctaaaaatttctttaaattgagggaagtaaaaaaaacaccaaaatcccaataagaaaatgaggaaaagtcataatcaaactttgttttgttttgagacagtctcactctgtcgccaagcctgaagtgcagtggcacgatcatagctcactacagcctcactcttccagactcaagttatcctcccacctcagcttcccatggagctgggaccaaaggcacatgcatgccaccatgcccaggtaatttatttttatattttgtagagacagggtctccctatgttgcccaggctggtcttgaattcctgggctcaggcaatccccagcctcagcctcccaaatcactgcggttacaggcgtgagccactgcacctggccataaacagattttcaaaaaacataacatgacccttaaataggaaaagatgttcagatttactcataattaaagagatgcaaattaaagctacacatttctcacttaacatattggcaaatatgtagaattgataacacattcagtcaatgaagcagtgaggaaataggtgctcttgtgtatttctggtgggaaggcaaatgtgtcacaacccttttggaagaaaatttgttaatatttaacaaaactaattgtgcatttactttttgatcagcaattccacttacaggaattctccctgaagatacactaattcagtaacaatatgaaaatacatatatacaaggttattcagtcattgtttgtaatttcaaaaaaaatggaaacaacctacatgctcatacgaaagacactggctgaataaactatggcatatgaacacaacagagtactatgcagccataagaaagaataaggaaggcccctgttgactgatatagaataactttcagtatacacctttaggtgaaaaggcaaagtgcaaaagaatatatactgtatactaccttttgtgtaaaaaataagcaaagataggccaggcgcagtggctcacacctgtaatcccagcactttgggaagctgaggcaggtggatcacgaggtcaggagtttaagaccagcctggccaacatagtgaaacctcatctctactaaaaatacaaaaaaaaatagtggggcgtagtggcaggaacctgtaataccagctacttgagaggctgaggcaggagaatcacttgaacccgggaggcagaggttgcagtgagccaagaccatgccactgcactccagcatgggtgacagcaagactctgtctcaaaaataaataaaccaaaaataaacaaaaactgagaaagagagatgtaatacatcagcagaaacaaatgaataacataatcatacttaatggaagagggtgaaaacccacccaagtgactcttgaactcagtaatgggactacacagtcataaacattatttttaagaactataaagaaatccccaggcgtggtggctacacctgtaatcccagcactttgggaagccaaggcaggcagatcacttgagcctaggagttcaagaccagcctgtgcaacatgccaagaccccgtctctaagaaaaatgacaaaaattaacagggcatggtgacatgtgcctgtagtcccagctatttaggaggctgagtggggaggatcacttgatcccaggagtggaggctgcagtgagctgagatcgtgccaccgcactccaacctgggctacacagcaagaccctgtctcaaaaaaaaaaaaaaaaaaaaaagaaagaaagaaagaaaactgtaaagaatctttagtatggctagtgttagtacatgtatttttcagtgatgtttgcaaggcgtgtcatccctcagtgtcatcctcaggcatcagtttcaggatacacacactcttcccgctatggatatcaaaatcgactggtgctcaaattccttatataaagtggaatagtatttgcatgtaacctaagcacatcctctcatatactttaaatctctatagactacttataattccaaaaaaaagtaaaagctatgtaaatagttgttctactgtatttttatttgtattattttttactgttatattattatttttattggtttttctcccaaatattttcaatcctaggttgattgaatccatggaatgcggagggcccactgtaattctaaaactacttgatatgcattctggggttgagcaagtgagtaaatatattgtggaaaaccggagtcaggtttctcactgttagagaagcgagtactaaatatgaaaagggtttccttctggaaggctagaatgagatctgtgagactagactagaattggatatatcagtatggactcacagtttctaatacatagaacaaggagggaagtatttttatatagacaaaaaattatacatacatttcctaacacagttggctgagagggcctagaagcaatgacattccagtagcactaagcacacttgccacccagatctaataccattcctcagtgaaaggaaacaaggctcttcggagaaatggctggttccaaggctgagagtgggaaaatacaagataagcctggaacatgttgcaacagaaaataaggaagtacttaaacaattatgagaacagatcaaaaggatacagacaggctgggtgcggtggctcatgtctgtaatcccggcactttgggaggccaaggcaggcgaatcaagaggtcaggagttcgagaccagcctgaccaacacagtgaaaccccgtctgtactaaaaatacaaaaattagccaggcgtggtagcacacgcctataatcccactactcaggaggctgaggcaggagaatcccttgaacctgggagatggaggttgcagtgagccgagattgcaccactgcactccagcctggcgacagagcaagactccgtctcaaaaaaaaaaagatacagacgctgacctgaaaaggcacccactgcctaaactttaaacactctgaccatcgaaataaataatgataataaaagattaaaataacgtactgaataaaataggaaaatataggtgtatactgatagaataaatgaaaaactgaaattctgatgaaaacaggatatttgtggagtttcaaagtacctccccacccaatgcataattacaaagggaaaaagaataactttacaatgaagaaggcttgatagacatttccttactcaagtgatctaagtgatcaccattctgaatgagagaaatcaatattatgtactacctgagaggatgcaatgagaaaacagaaatcgcttttatgatattcatttaaactaaatctaaccataaggaaacaaaggacaaacctaaagtgacagactatgaaacagctggtctgtaatcttcagaagtgtcaaggtcgtggaagtcccgcaaagaccaaataactcttccagactgaaaaaaactaaagaagtgtgacaactaaaggcaatgcatcattctgaactgggtagctctgctataaaggaaattatcaggacctctgatgaaacttaaataagggctgagaattagttggcagtaacctgtcagtgctaatttaccgatttgattctcgtattatgactatgtagaacatcctcctttgtaggaaatacacagtaaaatattacagcatgagagaagcattcggtcagctttactttcaaattgagaaacaaaaggttctgtgtgttatactaataacttttctataagcttgagactgtctcaaaataaataaaaagcaatatttcaatggcttgtttacattaattattacctaacacttcaaactatgagctcatatccccaggaataaaggtgctaaaaatcctttgtgacttttaggttgggaaagacgcatgaacctgtagtgtcagtcagtgctagtttgagaatatttgttcattaagatcatgtgattaaaatgtggtggtaaaaaagtcacaaaggatttttagcacacttattcctggggatatgagctcatagtttgaagtgttaggtaataattaatgtaaacaagccattgaaatattgctttttatttattttgagatagtctcaagcttatagaaaagttattagtataacacacagaaccttttgtttctcaatttgaaagtaaagctgaccgaatgcttctctcatgctgtaatattttactgtgtatttcctacaaaggaggatgttctacatagtcataatacgagaatcaaatcggtaaattagcactgacaggttactgccaactaattctcagcccttatttaagtttcatcagaggtcctgataatttcctttatagcagagctacccagttcagaatgatgcattgcctttagttgtcacacttctttagtttttttcagtctggaagagttatttggtctttgcgggacttccacgaccttgacacttctgaagattacagaccagctgtttcacagtctgtcaatttaggtttgttctttgtttccttatggttagatttagtttaaatgaatatcataaaagcgattgctgttttctcattgctattgtgacagctaccacctgtaatcctaacactttgggaggccaaagcaggcagatcacttgggcccaggagtttaagaccagcctgggcaacacagtgaaaccccgtctctacaaaaaaatccaaaaacactagccaggcgtggtagcacacacctgtagtccagttgctcagaaggctgaggtaggacgatcacctgagcccaggaggttgaggctgcagtgggcagtgatcacaccaccgtactctggcctgggtgacagagtaaggccctatctcaaaaattaattaattaatcaattaaattttttaaatttaattaaaaataaattattatttttaaaaataaggggttcatccatctatctcttttctgtgaactctaccagatgccctgggcaatgtttcttttgacagtctttttctttcaaattaggtgacagtttcttcctatctactatcatcagagctaccattactttaaccctcaatttttcatttcttattgtcttaaagatgaaggatttaacatttgccttctactccaaattaagtaactaagatgcatcctgtaatgtaaagattttacagggatgccaataagtgactgttggttttctaaagagaggaaccttctttatattagggtagacagtgttcatatgcaatctgtctacaacaattggcagcttgttctctgcatgtaacataaggcatgggacatagtaggactcagaaccatggtacataaatatgtccaagatataagagtgattctgttttcttaagtagtttgtgagtaactccattctaagtgaatgatctgaattttgaaatctagttgtagcagccaggcaactcaatggcaggctgttgttaggtgtttggacatctcttgacatccttttcttggccaagcacagcagcacagatcttcttttttagtttttatttttagacagagtctcgctctgtcgccaggctggagtgcagtggtgggatctcagctcactgcaatctccacctcccaggttcaagcgattctcctgcctcagcctcccgagtagctgggattacaggcatgcgccaccacacccagctaatttttagtaaagacagggtttcaccaagtcggacaggatggtctcaatctcctgacctcatgatccgcccgcctcggcctcccaaagtgctgcgataacaggcgtgagccaccgggcatggcctagatcttgttttagtaggccatgccttagctgactcaacatatattcaaactgctcaggggaaagagttgccacttgtaaagaggtttgaatttagagcatgctactaaattatacagagcaacaggcttgctaaagcttttcaaaataaaaatgttcaatcctagtgaaggcataatgagacgtaaacactccgggaaacaatttgacaagatatatatgatgtatctcctggaaatatatcctagctaattcaaaatgaagccaaagatttacgcacaaagatggtgattagctttttggataattaagaataaagactctaagcacccaaagaaatgacaagttatggaaagttcataaaatatataagacaatgtcaaattatgctatgagaaattataggaatacattaatacactcattctattaagtatacaaagcatagaaagtaaaattatacatctatttatatgcatataataaattatatatataataatcccaactatgtaaaacatatgcatagatttaaaagtaaaagaaggccgggcgctgtggctcacacctgtaacccagcactttgggaggccaaggcaggtggatcacgaggtcaggagatcaagaccatcctggctaacatggtgaaaccccatctctactaaaaatacaaaaaattagccggacgaggtggcgggcgcctgtagtcccagctatgcgggaggctgaggcaggagaatggcgtgaaccccggcagggcggagcctgcagtgagcggagatcgcgccactgcactccagcctgggcgacagcgagactccatctcaaaaaaaaaaaaaaaaaaaacaactaaaagaaaacatgccaaaaatattaagaatggtactccataaactgtggtttctcatttttctttccacttttaccccaatggtctataataaatagtattaattttacaatcaaaagagaactttttaaagcaaaacaaaatacagtctgatttgaagactttcaaatcaaaatcagtttttttcaagataatctttcaactcacaggaatacttacattcacagaattcaaagaaagaagtccaaagtagtcctaactatgacagcaaataatattataccagataatcctaaccaagcttagaaatagcctttccttcacattccagcttattatgcttattcttcattcagtaaataattattgagcacctactacctgctgggactgttttagaaacagatgtgtttaccaagcagtgaaaaagaagacatgacccgttttctcatagaacttggattctggtgggggaaaagacaacagacaggaggaaaacaaacaaacatggaatataatttcatacagtgctaagcactatgaaggaaaaaaataaagcaacataaaataacagtggaaagcaggaagctattttcaattgggtggtcagaaaaggtctctctgaagaggagatatctgatcatgcaagctactggtataacaacataaatagcattcctattgcgtaattgacctgggatttagaaaagtctgtttacaacttaaaatataaaaatcatccctatgaaaatagtttctactttaagaggcagtaaggtataatagaactagaaagactaggtttgaatcgtggctccactacatagaaggtagatacccctgtttaggtcacaagctctctctccctcagttcagtttcctcacatataaaacagacagaatagtgcctagcttataaagtttataaagtgaagaaagataatatatgggaaagagcttagtaacatgtttaggcatgtagtactcattaactgtaagttccctacatacttatagttcttccacaaattgagcactatatactaatggttctctgcgaagcactcactatttcactattgcaagtagaaacgtatcacatttttatcttccaaccacaccgaggctccaaagtccaaatcaccgctgactaaattcttgttagatattgatgctataaatgatactggcttaacaagattaatattatttttactaacctcatactcaccttttctttcatttcatcatgaactgtttccattttgaatccctaactccaaagtgtggcctccttccaatctgcttgtgatggttaattttatgtgtcaacttggctagactaggttatatggccagttgtttggtcaaatactaatctattagcagatattggtgtaagggtattgttaggtatgattaacatttacaatcagtagactttgagtctattacccaccataatgtaggtaagcctcatccagtcaattgaaggcctaagagaaaagactggggtttcccagagaaggataaattttgcctccaggctgcaacagggaaatcttgcctgagcttccagcctaatggcctgtctcataacattcaatcttgccagcccccatggtcatgtgagtcagtttcctaaaatatctatctactattgattctgtttctctggagaaccctgactgacatgctgatcaatcttagagttggtctccctgcttccgcctcttctttctatgtctacacagcaggtagagggatcctgtcaagacattcaatgacccctctggtaaaaattctctaatgacttcccatctcatgcagaataaaagccaaagtctacgaaactctagaagccccacagaatttctatgaccttcctccttccttccctgatttcatctcctactactttctccctcattccacattccagccagacattagccttctggctattttaacatgccacaaacattcctacctctggggcttgttgtacacttgctgttccctctacctgggattcttttcctccagataactgcacagcttgctccctcatttccttcaagtctttgctcaaatggctttccctcttcgctctatttaaaactgaagcccttcccaaatcttggggtgctctattccccccttttctccacagaacatattactatctaacatcctgtgtactttactttttttttttttttttttttttttttgatacagagtctcactctgtcgcccaggctggagtgcagtggcgggatctcggctcactgcaacctccacctcccgggttcaagcaattttcctgcctcagcctcccaagtagatgggattgcaggtgcctgccaccacgcctggctaatttttgtatttttagtagagacagagttcaccatgttagccaggctggtcttgaactcctgccctcaagtgatctacctgccttggcctcccaaggtgctgggattacaggcgtgagccactgcacctggccgttttactcattttctttcaccactaaaatgtaggttctgagacaacaaggctttttgtctgttttgtgcactcctctattaccaggccctatgcctaacacatagtaagaacatcataagtcatttgttgcttgaagaaaaaacaaaagagtgaagactgatttttaatttactctttgtgttttcctatatttcccagttttctacattgggcatttatttctattataatcatacattgctgatgatattaaaaactagaataatgtttttgctagtagattaaaaggcttaaagtccagggctgggtgtggtggcccacgcctgtaatctcaggattttgcaaggccaaagcgggcagaccacttgagctcaggagttcaagaccccagtccggacaacatagggaggccccatctcaattattaaaaaaaaaaaaacaaggtccacttcctttgactcagaattttttcagtgaataagataatctaaggtatgaagcatgaatgtacactaaagtttaatgaccttaatgtccattaataagagactgattaaattattgtatacccagacaatgaaattgcagttattaaaaatgtaccagcctggggaacatagggagacgccatctctacaaaaaatttaaaaattagccaggagtggctggtgtgtgtctgtggtcccagctacttgggaggctgaggtgaaaggactacttgggcctgggaggtcgacgctatagtgagccatgttcacaccactgcactctagcttgggcaacagaatgagaccccgcctaaaaaaatagaaactttatttttaaaaataaaaatgtaggccaggcatggtggctcacacctataatcccagcactttgggaggccaaggtgggcggatcacggggtcaggagttcaagaccagcctggccaacagagtgaaaccccatctctactaaaaatacaaaaaattagctgggcatggtggcacgtgcctgtaatcccagctactagggaggctgaggcaggagaatcgcttgaatccgggaggcagaggttgcagtgagccaagatcatgccactgcacaccagcctgggcgacagagtgagactccaactcaaaaaaaaaaaaaaaaaaaactgggttatacttcagtgtatggagtataaacctatataaaaacaaaaagtatagatagataagcatatctatatagaaacaaaatgacagaaaacaaagaacagatattaaagtgaagtgagattatgattgactggttaatttcttcttcatgcttgtccactctctaaaatctctgccattaaaaaaaaagtgttactagccaggcatggtggctcatgcctataatctcagcactttgggaggtagaggcaggaagatcacttgagcccaggagttcgagaccagtctgggcaacataggaagatcccatttctatttaattaaaaaacaacaacaacaacaaaaatcaaacaaaaaaagttattttcataaacagaatgaacagtaaatataaaccaacagaaataaataaaccaagcactcttacaagcaacataataaatgtctatagtatcaggtacatgacatttttgttcaagaattaaaaagacgttttttaatgtgttctgaattccatttacccacgtccctatcctcaaattatactgtgaaaccttaatctatcatacacattgttttggaaaccataaattacaactgctagtaaggcaaggtatagttttcattctcccatagcacaggctctcttccaaagggaatgtgatttcttagtgctagtactatatgcaggcattgtgttatcattaaaactttctctaaaatattaatttatttgctgtttttcctgctgcttcaaattctcagatcaccaagtcatcctcactgttttcagaaaatatgacatggaaatttcaatgcataggaataacgtttgacactaaactttcaaagtccatatcatcagtaagacactttcaaactagtacaacatataaaagacagcatgatacagttgtggatgatgagcttacaaaggttgatggctgatgataataataggaaggtgaagaagaataaaagcttgaagaaggcttcggtgacttcacatcattggacacaaggaagtgaaacatgcgcatatgatatcaaatcaatgaaaaaacactagatcagtaaatagtatgcagacaactgataggtcattcagaaagaatgtgcatccctaattcacagcatataggaaaataaattacagagaaaatgaaagattgcaaagcacaatgctataaaccactagaagaatattataagaaaggaacaagtatagccacacaaaaagtaaacattttttcaaaactttcatcatggccaaaaccattattaaaaaactgaaaggcaaatgtcaaactgggagaagtatttgcaataaataacagttaatatatttaatatataaagagttcctataaatcagattttttaaataaggccatcattagaaaaatggaaaaaagaacatgaagaggtaactcatataacaaccacagaaatggccaatgaatatttttatgtatacatatattccaacccattagcaattaaatgtacattataacaagataccatttctgcattttcatccatcaaaatctcaacaaagtacaaaattaaaatattcaatgtcatctagagtatgaaaagggatctctgatgggctgcttttaagagtataattttacccagcttctcaaaagtacaagttagcaacctaaatgtgcacactgtcttacctaagaaaataatcacagaagtatacaaagacttaattacaatgatgcttaactccacatggcttaaaatgtctcaaaactggtagcagtcttaatatggaagggaagttttcttaaaatcattaatatatttattaaatggaatattatacaatgattttaaatgatgatagaaaatcttaattcatcatgttactatttgccagtttttatttattggtttaactttgaacaagtatgttatttttagtaatacttttaaagtacaccttaaacatttttaaatgatattcaggggttatggcaatgcttggaatataaatgggtctatcttccatgaaagcaatttagccatacctatcaaaataaagcactgttcactttaagataaatcactgagctgtacacacttaagatttttgaacttttctatatacactttatacttcaaaaatggaaagaaaaaaaaaaacacctgtactctcgcctccacccctaaaatctagggatgataaaagtaccattcatgaaagagttagactttactaatctggggacatgtctataacataatgttaaataaataaagcaaataagtgaccccgtattgtgatttttctagggtgagcccatttcctctattcaaaaaaaaatggctgggtgcggtggctcatgcctgtaatcccagcactttgggaggctgaggcgggcagaccacctgaggtcaggagttcgagaacagcctggccaacgtggcaaaatctcgtctccacttaaaatacaaaaaattagccaggcgtggtggcgcacacctgtcgtcccacctattcaggaggctgaggcaggaggatcacttgaacctgggaggcagaggctgcaatgagcccagatcatgccactacactctagcctgggtaacagagttagactcggtctcaaaaaaatacataaataaataatttttttttaatttaaatgagggaattctgatagttgtcagattgcataccctcctatgaacaaagaaaacaaatatacaatgataaagaacaaaatgttaacattcgtttcttagggggaaggaagggattagaagggagagattactaaacttttctgtatataatttaattaagtcataataaaatactgatattccttgaccaagcaattacacatacaaaatcgtacaagcctaaagatacatatgcaatgaaatcactgaagttcctataatacaacccccgccacaaaagacaaaaaaaaaattgtagtctaaaggcccctcaaaaggaaaactagccaccgggatcagtggctcacacctgtaatcccaacacttttgggaggctgaattgggaggatcacttgagaccagaagtttgagaccagcctgggcaatatatcaagaccctgtctgtacaaaaaactgaaaaattatctgggcgtggtggcacatgcctgtggtcccagctactcaggaggctgaagtgcgagggatcacttgagcttgggaggtcaaggttgcagtgagccatgatcctaccactgcactccagcctgggcaacagagcaagacccaatctcaaaaaaagagagagagaaaaaaagtggctatttttttttgaaaataaaaaaatgctaaagccctgtgatgtagcctcccgagtagctgagattacaggtgcatgccaccatacctggctaatttttgtatttttagtagagacggggtttcaccatgttggtgacctcaggtgatccatttgcctgggcctcccaaagtgctgggattacaggtgtgaaccatcatgcctggcctttatttttaatttcttgaagcttgtttaaaaattttttaatgctagcatgaaacagtggtttgtaaaactttgaggcattttaggtttgcttttaaaatgccccaagaaaaacaaaattgaagaaaagttgaactaagattagcataattttgaaaactgttcaagattaagttgaataattctcttatttttgtgtgtttagctatttctataaggagaaagtttttaaaatgaaatcttcctaagagccccattaagtagaatagataaatccagagccattctaagtgagatcgaagtaggaggcacactgtgctagcccctcctttatccctctagtgactccaaagtcaagctggggttccacagggcattaaaaataccactgttaaaatcagcagcagcagaataacactgcacaatttgatggattcctccctaccgaacagacaggaggaagtaaggccctaaaatagcaacaaatgttctctctgggtggtagatgctcacgctaccaatggacgttttcttctttttcaaagtctatttcgtaaattttcttataaagaggaaagatgtggttttttttaaccatatatacatacacatatatgtgtgtgtatatgtgtgtgtgtgttgtgtgtacatacatatatatatatatatatatatatatttttttttttttttttttttttgagacggagtctccctctgtcacccaggctggagtgcagtggtacaatctcggctcactgcagccgccacctcctgggttcaagcaattctcctgcctcagcctcccaagtagctaggattacaggcgcccatcatcatgcccagctactttttgtatttttagtagagacagggtttcaccatgttggccaggctggtcttgacctgacctcaagtgatccgcccacctcggcctcccaaattgctgggattactggcgtgagccaccgcgcccagcctatttatatattttttagagcaaacccgtggcctgcaggcccccaggacggctttgaatgaggcccaacacaaattcgtaaactttcttaaaatattatgagattttttttctttcgcaatttttttttttagctcatcagctatcgttagtgttagtgtaattttatgtgtagtccaagacaattcttcttccaatgtggtccagggaagacaaaagattggacacccctgttttagagacaaggttcttgctctgtcacccaggctggagtgcagtggtgtgatcatagctcactgtaacctccaactcctgggctcaagggattccccaacctcagctcccagagtagctaggactacaggcacatgccaccatgtccacctaattttttattttgttttgtagagacaaaatacaaaaataaaatgtttgtagggccttgctatgttgcgaaggctggtctcaaactcctgccctcaagcaatcctcccacctgggcctcacaaagcactggaattataggggtaagcgaccatgctcagccaaaaatgtaggttttagtgtctataaaatactacagattctaccactgagcaacccaaaacgttcacattatcagacccagagtgctataggataattaagataatcaacaagaaatgacaaatccctaatgcttattagaaaacagacaagaggcaatgaattcaaacagccatgtctgaccttagacagaccgaccctgaacaaaaacagccttatcatatgcatggtcttttagctaatccttacctagccctggaatctaagactgaaattccttcttacatggagaaccaggagcaagtaaatttaaaaaatggatttcataccccccaagagtaagaatcagtaagaggtggcaattatctttctctacctcataaaaaccctttatgatttttaaagatgaggaaacaggggttcgggaaaataaagtaacttgcccagtatcacaaagtcattaagtagtaggaacaggactagaatagaggtttgtctgcaccaaagccagggttctttctaccaagctatctccctcctctaaaaaatattctcttatatcaaaagctatgataagttctgtggcattctcagaccactgtggctcactacacctattaaaagtaaaaaaagaaacaagaaaggcagctgtcaagaagttgtgctacttactgcccagcactatatgcactagagcttggaaggaggcactcaaactcaattcacgtgatcctcactgtcattccaagcaatcagtcctaccccagcaaaaggcttatcactaacactctcccccagctgaggctgcaaatgacattcccaagacaacttgccagtctattacatcatgctgctgtgttggctttaaatttttaactccaaaaattaaggggaatttgtttcaacctaaaaatggcagttgcaagttaaaatggcagttgtcactacagactggtgactagagcactggctttgcagtcatccagattatgttcctaacccagttctgccacttaaataaatgtgtaaccttaggcaggtcaattcacctctataatttcatatacaaaaatggcaaggtagataacttttccataaaagatcaaatgagataatccaattcctagagtccaacacatagaaagaacgtggaaaataaatgatacatactattattaacattggtatgattctcatgccacaggaatctgggcaaatcaataatccacatggtctgaattcctgattatttgctataacaatcaactggttgaatcaggacatctgaggcaaatgaaacactgactcagttcagcttggttgagagataaccaatagaggccctggcacataccaattgctcagtaaatatttatggaattaagtttgcagaaagtccactcaggaacctcactagctgtaagattcaggagggctcattttggcaaaaagaatggcaactttttttttctacagaatttggcaggtttttcttttcttattttcaaataatattaataactaaacaaaccatataccaggtgtcaatagtgaggtttctacaaataaaaccaacatggaaaactacaaaagcagcattccagagtagaggaaagaaaaccagtttgggaatcaggcaagtgtgtgattcatatgccagtaactttacagttatgtaaacattatcttgggccaaatagtcacgtcagactcagtttccatatcagaaaattggagataagaacacctacttcacagggttgtcataaagctaatatatgtgaagcaccatgtaacagttggtaatgagtgatttttaagtctctgatacctgttttcccttctagacgatggtagaaacttccggaatgggtaaattatgcctaagggcaactactatcttccctccggctttttcgaaaggtaaactaaaattcagccatatagacaggtcaatgggctcaagttgcaattatcagtgggtccactctgacaattttaagggggactctttcatggaacttcagagaccaggaaagaaccaggctctgttctctccaggtagcctaactattccttcccttctcaggcctgctctaatatgaggttgctaaaaggtgtgcaaaggaagagtcatctttgcaataaaccaaagatgcagcatataagcaacaggccttctttgagagcccaaacccaaattaaggcacgaaattttagcactgtttggagactggaggtaaaggggagaaatgttggcattaaaataatacttaaatgagtacagaggaaggaagtcttccaggctcattaatattaatacatgtttactttccattcacatgtgggacaaaacagagtaatgatttgctaatgccaatgagctgagtacttagttcattttactatgctgcataccctcaattatatactagcaaaaattaaacctaagtaaacagaatactctacacgtctctaaagacaatattgctccactcactgaaataagacccaatcaaggcaaaaaaaaaaaaatctttttttccttcttaagtgaatttcactaagaaagatgagtcaaggaacttttaacaaatttggatttccattttcaacaaggtaggaacccgtgtacctcctcccactcaccccacctccagagaactcacaatactgttactaaaatatattgaatgatgccttccattggccaattacttttaactgaatgcaataaaaagaatccgcacttcaagacctcactaacaactacaatttttccccctcttaaatttccagttctggaaaaaactcggtcagcccactaaaaagcaactgtaacattccttttaatccagaaaaatagagacaaaaatacacctattataatacacctattatacacctattataataacgcaaatatccattatacagcatcaaggagagcacatgcaataatggctgccattccaagaacatttttgttaaaagttacatcgcatgcacagaagctgcttttccaaaagtaaacatatattcattacactgagcctcactgaagcatcctgttcttgtaaggtgagacttgtaacccacctttatatacagaatctaaagacaactgggccttatattgaactcgctctccagttaactgtgttagtgaggttccagtacagttccccaaagaaagcaatttgaatcaataaccacaccagtgctactctgaatgtttgccaataagtaaataaaatgcctgactccaatatgaagaacattttcctccttcctggctccccagctccatttaaaaattgtaaacatgaatagaaagataaacttgagaacagcaaagtcacccatgccatcaataatatccctctaactcagtgcctaattttgcagttttcctcaaacaggacagtctcaaccagatgccaggaatttaatatggcttttcaaagatatatcaaactgtctggaatatgcagtgatgaaaactgaatattgctactgaaaccatatttaattaaacacatgcttgctcagagcttcagaaataaagctacaatgttttcttccttggctctcttagaagccaccccaacaagagagggtcaccagctgcactcctgctaacagttctatcctgagcaaccctttcccatccacccccaaaaagttttacttttatctgtggaattctctgccggcctcggcctggaaaactgggtggaccctgaggacaggtgtcagatctggcctttgggaggtggcccaaactgacaaattattggcagcataaagctatgatctttataaacttcagtttgaggctttatgccagtagtgattccctccccgctccttttttgaagaggggagagaaagcaagccaaaaggatgagtttcaaaatagaaaaaaatcaccactttaattatgaaaccctcccaactcaacaaagaactgttaaaggtagccaaatggaaaatgtcaggagttttttttggcacatgcgcaactattaaacatgagaattacaacctcaaggtgaggggaaaagagtaaaaagcaggagcagaaaaggggaggacagggcccagccaaagacccgtttgctcaaaagggcccctcttggtactaactcctccatgtggggcacccaggctggaggaaagcagagggttacacagaacatttagcagacttaacattggattaaacacactactgcaagtttcaacaaatgttcatggcatacgtaaaaacacatttacaacaagaaagaagagaggcacctggagacatctgacactgggcatgctctgcaggcaactcagtgcgcacatgctctctaccaggttggcgcagcctagccacaaagaccttggcacagaacactgcaggatgacaaaaaggaaggaagagaagaagcagttagaggccgcaacaaatcactccttcacacaggcaacttgaatgttagttggggcagggggtgcacccttggcagtttggaggttagggatggtcccagacagctcactgaaaccttgggggagggcccacttgatgttctatggaaaggaggtttctgctgccaaccactaatttctcagggtacagtgaatagaatcaagagggacagagagaatgtttaaacaaaaacccaccaaagggaactgtgaaagtttgagtgcaaaacaagattagtggtgagattgtcgactacaatttcatcagtgccacagtttctcgtctatgtcacataaccataattgtcatcgttgtttaagaacctacaaaaccacaaaaagtgctatttgcccagcactttacatttgttctctaatcctcatatcattgtaaggaaaccgaggctcaaaggttaagtgattcgcgcaaggacacacaacaaaggaggggagagccagaatttcaaactttggtttgtctgctaccaaaacccacattctttccacaagactatgatgctgctattgtgaaaacttatatcaccccaacttttatcatgtgagtaaagttttgcacctccctaaggtaaaatcacaggagacctaaagaataaggcaaaaagaacaagaaagatgggtgacagactgatagataaaggcaataaaagaggtgatttaaaatgcatgattttcagtgtcatcacatctccaccttcccaaaggaaaaacattggaacgtcatgattttcattttagactttgtttacaaagtccgtctgacatgactaagaattaaaaagcttatttaatttacctcttcgatcctcttttaaaagcttgctgattttaaaggaattaagaaaaaaagtaaaatataaaatgaacatatgtactacggctactacttaataaccattagaccatactgtaaagttaataaccattagaccatactgttcaatcattcagatataaagtcaattaatttactatggcaaaatcaatactcatgtaacaaaaattaaaggtgagtgtttgggttcaaccaaaacatcccagaagtcttggacccaagctcataaacttgtttgttctagctataattagaatagccaaacaccctcatttgcctgagatagtcctggatgacacttattgtcccctcataactttcactctcaaaagtgttctggtttagtggataaattctattatcacccaactgcaatacaaacaaagatagctttgcttgaaatcagagagacctgggttcctatctagtatctgtcacttactagttacagttcacctatgatacacggaatattgagattacttagaaaaggcatttaaagaatacaaaatcagaggaaccaaatggaataaaaaaattgagcagctttctggtagcaatgaaaatgacacacttccaaggtgtgcctttattccaaagccaatacagtggcaatatatcattgaaactccaggtacacaaattttgttgcctcaacactttgcagagtaccaaccacagaaggtgctgaataaaataatgaaataaaataatgaaagtagttgccatttatcaagcttctgttatgtgctagacagctgaaatagtaaactctcacaataaccctgtaaaataggtattattccattttatgatgaggaaactgatgatcaggaaagagatatcaagcagagtcccatggaattttttttccattaagaaaaaaatttttttaattaaaacagaaaggagagcctgatttgttaaaacagcaacacagaccaggaatggtggctcacacctataatcctagcactttgggaagccaaggtggtcagatcacttgaggtcaagagttgaagacaagcctggccaacatggtgaaaccccgtctctactaaaaacacaaaaattagccaggcgtgtggtggcacacacctgtaatcccagctacttgggaggctgagacaggaaaattgcttgaacctgggagtcagaggttgcagtaagccaagaccacgccactgcactccagcccaagcgactgagcgagactgcctcaaaaaaaaaaaaaagaaaagaaaagaaaagaaaaaaaaccagcaacttgtccaaggtgcaggggaataagggctaactgatggcagaattaggactagtaaattaaacctgacaagctgattttctttccactacaacaaacactctctatccagagatattcttacacatgtttaataaaagaatacttacatcagcatacatcacaagtggatgggcaaagaagagagtttaaggactacacctagccaggtgaggtggctcacgcctatagccccagcactttgggaggccgaggtggtgggattacttaagcccaggagttcgagaccagcctgagcaacatggtgaaaccccacctttacaaataatacaaaagtagccaagcatggtggtatgcacccatagtaccagctgctcggaaggctggggtgggaggattgcttgagcttggaaggtggaggttgcagtgagccaagatcgcagcactatactccagcctgggcaacagagtgagatcctgtctcaacaacaacaacaaaaaaggattacatctggattcagcaactaatatcaaattaacaccaaagctcatacgtaaatcaatttttacttattcagtaaaaagtcaggttccctctgcaagggttaatagtatttgcctcaaagggtaaaaaccatgaaagcataaggtattgattagattctgctaataagttggaatctaaaactttttaaaaggcaatttttcacattcagtaaatcaaaaaatcacagattgtgagaacaggaaggcattttaaatactatttagtataacctcgcactgctaattttagattaagaggtgaagaaattaaatccaaattagaaaaacaatgatattatcaaggctttttaaccatttaatgatttaatcaatactcataacaatgtggaaaacaatcaacataaagaaaattttcagtgaacttgattttaaaacattagccatttattagaagactgatatttcaaagctttttgaagcttgttatttaactagtatattcagggaaagatttttaaaagaccctctgagggtcagatttccaagattttctcttcataatatctatggtagatactgtaagatataaagaatgatgccagtatttattagatgctgacatcatgctaaatactttataaaggatatctcatctcatttttacaataatcctacacaatagacattactttccccttcagaagaggaaacacaggctcagagatgaagtaatttacttatccaaaatcgcatagtgctgggttggtgctaaggtctgaggcaagagtactcttcactgagacagcttgatcctaggcagcacccaagctggtgtgtgatgcaactgccaatatctactaatcagaagtctcaactctcagatcatcccaggactgggaacttccagtttcaagacgagtgttgttttccatttggtaagaacacagacagtggttaaaaagtattacaactgcttactttcacactcaataattactttgaagctaagtgaccagccacattgctgaaaatcatctctactcaacagaaaatgctattctaggaaatacacccaccttttagtaagaaagtctgtacccgctagccaaaacaaggtaggttcctcttaggtcttagatctaatagatcaggaggacattgatccaatttgaaaataatggataaaaataaaagttccacattcatcaacctaagagcattaaattacagctaggaccacaacagtaattgattttttttttcttttgagatggagcctcgctctgtcacccaggctggagtgcggtggcatgatcttggctcactgaaacctccatctctcaggttcaagcaattctcctgcctcagcctcccgagtaactgggattacaggcacctgccaccatgcccggcttatttttgtatttttagtagagacggggtttcaccatgttggccaggctggtcttgaactcctgacctcaggtgatctgcctgccttggcctcccaaagtgctggcattaaaggcatgagccatggctcctggccgtaagtgattcttgaagcttcaaatttttaatttagggacatggctggaaacccatgttgatcattcgagaataactattatccatgattgcttaactattcagttagaataatgaaaagatttcttcatattagctaaattcacagtacagacgattgtcctttttttttaagtgagcagtgttctttcatattgctaaaatatgtctgaagaatacccctgataccatgggtatttaccaattttaacaaatacttattgacctgcttattaagccaacaatacacactaagcctctttccccttaagactttagccttgagctcaagagaaacaacccaggaggatcatagtggggatacttaacagaagactttggagggtcaaaaattgccaagatacatttgttataatttcgtatttagctacttgtaatgattaatattctaatttagggttgttcacagagaacaggaaatgattcataatgggttgtgatattaacagctaatacctaattagattgtatatttgtaggttctatagctgaagaaaataatattagccagggaagctgacagtgtttattacttttgccatatccaccgtataatcaaaaaaacctaaatcgaaaccattatgctgagaaacaccataagtcagtaaagacaaaaagaataatctcttttggcatttttcaaaagcaaaaagtttattaaaagaggtaggagaaaaatgtcctaggctctcttcctattaccataggaaccacaaatcaaaaggaaaaagtggttgcaggcaccttgtattctgattggctcacttgaagaactcacaaaagctaacttcggtctgtttttagatgggattgttttgaatctcctgccctgattccttctcaaagaagcagttcttttaaaatttccccaaagaggtattttatgttaatcatctctctaatgttataacctctgatttagaaatctgccttattataggttttctataactccccccaccaccaatctttttatttaatccacttcccacagaatcattaccagcttcttctcactcctgtcatcatgattgaagtaatcaagttgagtggctgttccattaaccaaaaaacttatctgaacttatatctatctgcacatagtaaagcaattaagacattctctttattctccaggagctcacagaaggcaatcttaaacttataatgtaaatacacatacacacacacacacacacacatatatatatacatacacacacaaatatgaacttaacccacccaaaggaagaggatgcctgaactaattcataaagggtaagtaggaggcagccaggggaaaaagagaaagacattccaagaagaatacatagcataagcaaagccaaagaggtaaaaaatgaaacatcctatgcaagtatctgcaattaatttagcattaaaatacttaagtgtgagatgagaaaggcttaattagagagacagggagggaccagaggtctctctatcaaacttgtgacttaatcccgtagaacaacaggtcttaaactctgtgctacagcccatcagtagttggcccaatgcttctcagctgtgtcatccaattttacatcaatgtgaatgacttttttttctgcaactcagcagatacacagtttgtacaatatctgtcagagaggaatagaaacagatcatgcaacacagagatggaggtggaggtggacaggggatggaggtttttagattaagaggtaaggggtgaagcataacatcaagccaaagccaagccaaatcaagccagcaacaaagaaatatcccatgttttctagaactcgtggagaatatttgccgcaaacgataaaagaagtctgctcaacagtaacccaatgacaaagagtgtaagcagatagtacaaaaaccaaggatgtttttatagatattatattacggattttgttaaagaccagagtgttctgaatgtgttaaattcctttaagtgagacatccaaaattttaatattcaaatcactgctacagacaatgatgagacagctattaaactgttttaagcaaaggaatgacccttggcagctgcagccaagcatgatttgcagagaaataaggataagtctcttcgagaatctataagatagcagctcatttttgttttacaaacaatgcaatttctttcagatgggctacaaagagtagacacaagaaccagcacttaccaactttcatactcagtctaggtccttttttctccccccacaaaacttccaccaggccctactgatagaatatcaaacaaagagtgccatgataatgatgaagaagagaaataaaagatcaatttcatggggtaaccatttggcagtaatgccctttccactgggaatctctagccatgagtgaggactgggtcttgatgaatcagacaataggtgggctcaaggggagtacataactccagctctctaaacctagacttgacagctagagtccccattcagtttctgctgaagactgccaaataaactaagcattaaagttaacccaacttaggaattatcctattgtgtctcatctctcagcctgttgcttttcaagaagcagcagtgtttgtaattaaagtaaggacaaagcattcagaagagtcttctaaaattcagaacctaggcttccactattaatgtctgatggcaacctataagaaagagcactctcaccaccataaatgcattgtttttaaaaccaagaatcacaatgtagcaatcaggttgttaaataaaagttaattcacggtttaaggcattttctataaccttttatagaactgaatattggcccattaccctaatgtgcaaaatactttcttttccttataatggcattttattataacagaatttgatagtaaacatgtgacatgtaaccaaaaagtttacattttaattcttagcaactgtattctagaattatgttcttgtcataatattatatcacagggtatattcaggctgggatatatgttaagggaagaaaaggggatgcagagaagtaggcaggaaggggagaaaaaaaataaggatgagaagaatgaggaaaaccaaaatttactatctgccaagtttttagattcaagaacagcccaaaagtagtggaatcaggactcaaagtcagaggccaaactttgcttaaacaccactataatttttttaattaatgtccaaacaattttcatcttgaattattctaaggtaagatattagaacccatccaggcaagatggctcatgcctataatcccagcactgtgggaggccaaggcaggagattacttgatgtcaggagtttgagaccagcctggccaacatagtgaaagcctgtctctactaaaaattacaaaaaattagccaggcaggtggcacgcacctatgatcccagctactcaggaggctgaggcacgagaattgcttgaacccaggaggcagaggttacagggagctgagatcatgccattgtactccagcctgggcaacagagtgagactcttgtctttaaaaataaaaaaaaaaaaaaaaagatatcagtacccaaaagcattaaaactaaaatggatcttcactgtaatctctctggtagagagatgaagggtaatgttcttttcaaatttttattcatccatattttccgatttttctccaatgaccacctagtactcatattaataccttaataataccaagtataattttaagtgatgacttattttgtttaattataaagagtaacttgacaatttttttttaatggggcagttcacaacatattcatgtagtttggctctgtgtccccacccaaatcatatctcgaattgtaatccccacgtgtcaggggaggggcctggtaggaggtggttgactcatgggggtagacgtcccccttgctgttctcgcgatagtgagttctcacagaatctcattgtttgaacatgtgtggaacttcccccttctcaccctctctcctgcatcagcgtggtaagacatgcttgtttcccctttgccttcagccatgattgtaagtttcctaaggcctcccaatcatgcttcctgttaagcctgcagaactgtgagtcaattaaacctcttctttatgaattacccagtctcagatagttctttacagcagtatgagaacggactaatacacaatttaaataaaaacatattcttttaccaggaattaattttgagtccatcttaaacatccacagtttaaaatgtgtttaaatgctcagtgctagaaaaatatttcacctagtggcccttggaaacatcaaaatcataatggtttattcctgaggaaatccaaaggaaaaaaaaaatcatccttgtccactttacaactaccacccatgattcaaaaatgtcaccaagtttttcagagctcttacagaagctggaggaggaaagaattagatgtttgaggtgggaagtggaatctctattctaagcagcatgacagagaacaggatgtaacaaaataatctatttccggcatagccacatggatcctcagttgtactaggaccagcgtgaggttcagctgccaagggggaacagaatcccccagcaagctcaaggttaaatcagtctgaacccaatcccaatgaggtttttccaagatccataaatcctgagcctggagataatttaacacctaagtacatctgggcctttgttggttagcagctgtggtccaactaggaaagttgttcaggactagggcgagacctctcaaccctaagtttaatctttttcaataaaaatgttaaatgacatgaaaattaacaaagaaggataaattgggagggggtacaaagtgagtaccctatggctataccgtactcattaactctcataccacctctggccaaacaagcagctgagttttacagacaagaaaaactaaggaccacagacatcaaatcacttgccagaggtcaagaatggcaaaactgcattctatctgactctaaaatccctgctttcttcccttatctataattgcccgtcacttcctttacctgacattaaactccgtagagcagcaagtttccctgatttattttcaaattttatctacctgtcactcatctatattgctgattgatacaatctctggtatgcaactctgcaatacatagtcaagacttgaaactcatgcacatcatttgactcagcaatttcacatgtaagaaattttatcaaggagacaaaataaagaaatgtccaaaaatatagccaagaagatgtcattcacatcactgttcataatagcaaagggaaaatgctaaccaaagggacaggttccacagattagggattacccataagacaaactattgtgtttctgctaaatagaaatcatgctatacgaatatatttacagacactaaaggaagtttaatgcatagaaagaaagttacaatacacggaaagaattcaagaaacactaagtgaataaaggcaacaaaccaggacttacattatgatcccatgttcatttaataaatataatatatacataggccgggcatggtggctcatgcctgtaatcccagcactttgggaggccgaggcaggcggatcacctgaggttgggagttccagactagcctgaccaacatggaaaaaccccgtctctactaaaaatacaaaattagctgggtgtagtggggtacgcctgaagtcccagctactcaggaggttgaggcaggagaatcgcttgaacccgggaggcggaggttgctgtgagccaagatcacgccactgcactctagcctgggcaacaagagcgagactctgtctcaaaaaaaaaaaaatgcatatatatatatatatatatatatatatacacacacacacacacacacacacacacacacacacatataaatctggaattaaacacaggtgatttttattttattcttttgggctgccatattttttcagatgaggccatacaattgacagctcaaacttctccattccctctcctctgagccacctctaaacagaatattggcatttccacagttacttagggatcttatcatagcaacttgccccctgactgtagtagaccattctcctaatgaaggtggagagcaggtagggttaggacagctataagaatttggttgccgggcgcagtggctcacgcctgtaatcccagcactttgggaggccgaggtgggcggatcacgaggtcaggagatcgagaccatcccggctaacacggtgaaacccctcgtctctactaaaaatacaaaaaattagccgggcacagtggcaggcacctgcagtcccagctacacgggaggctgaggcaggagaatggtgcgaacccgggaggcggagcttgcagtgagcggagatcagccattgcactccagcctgggcgaaagagccagactctgtctcaaaaaaaaaaaaaaagaatttggttgcactttgaggtaacaaagacactctcctccattcatttcaatgcttctggcttctagatagctaacagatgatctccagtcagaaaactcctaagtatcttctaagttactacttctaaatatgtgacagtatatagtccataccgcatgacatctgagaggtcttccaggtgacaaaactaaaaccccaatttgttttttagacattttctaggaactgagagacatctgctctcatttatactagtgcccctgtccccaccctcagttaatccaacttccccttccctaacatctaagacactagtgctggctgcatcgcttcctgctccttctacccaccatcatgagtcaaaagactttaatcagagaatttctggaaatatgtgcacaacgagatcctgattgtcctctaatataccaagccaaaatccttaccctactttcatttaacagagggcaaagttgactacgtttttaaaagaacattagaacacacggaaggggccgggcgtggtggctcatgcctgtaatcctagcactctgggaggccgaggcagatggatcacgaggtcaggagtttgagaccagcctggccaacatggtgaaaccctgtctctactaaaaaaacaaaaattagccaggcgtggtggcacatgcctgtaaccccaggtgctcaggagtctgagccagaagaatcatgtgaacccaggaggcagaggttgcagtaagctgagatcacgccaccgcgctctagcctgggcaacatagcgagactctgtcccccatcaccccccaaaaaaaagaatgtatggaagggaaaactttttctcctgatgtaatgaacattctcatttttttctaagaagagataccactttctggaagatgacctgagaaatgtatcttctctcaataaaggtttgacccaattatagtcagactacatcatatttctattttatctttttcattttaaactgcttagtcatttaaaaaagtttactaaacatcaagtatactaaatgctttgatagacaaaaattctcaaaactatatattctggtattaaaaattatttctgcaaataaagccatattgcttaaattatttcctggtttgctaaacggaaaaagatggctaaattcctaaagtatgaaacattttaaataaatgcagttccactgccttcaagagtattaaaacttaactagcagctttttttgtttttgtttttcagacaaaattgcgctctgtcacccaggctggagtacactggcatgatttcggctcactgcaacctctgcctcccaggttcaagtgattctcatgcctcagcctcccgagtagagctgggattacaggtgtgcaccaccacacccagctaattttttctattttcagtagagacggggtttcactgtgttggccaggctggtctcaaactcctggcctccagtgatctgcccacctcagcctcccaaagtgctggtattacaggaatgagcaaccacgcctggcttaattagtggtatttttaacatcttttgtagacttaacacttccaaagactttgaaagtccatctaacatgctacttgtctcattgagagctctgaaaaagtacctgcagaataaaagttggccctgttaaaaaatcttttgaattctgctatgttttggcttcatgtccccacccaaatctcatctcccattgtaatccctcgaaggagggacttggtgggaggtgactggatcatggaggcagtctcccccattctgttcttggtatagtgagtgagttctcaggagatctgatggttttatgagtgtttgacagttcctcctctctcacctgccaccatgtaagacatgcctgcttccccttccaccatgcttctaagtttcctgaggcctcccagccatgcagaactgtgagccaattaaacctcttttcttaatatttataaaccacccagtctcgggtagctctttatgcagtatgagaacaaactaatacaaattcaaaccttacatcatttaaacaagccctctactattttataaacactactcatttcttgaatacatacaacatttattttcaaagacttaacaggcccctacaccaaataaatacatgttccaagttagtagtgttttaattttatatacatacgcccacacagagatttggaaaacaatggtaataaaaattttgcttctttagctaagaacagcatgaaaagcgagttgtcaaagataataaagtggcacattttatcatcccttaattttacagtaaagtttacacttgctcttcttcatatagttcattgttcttatatcctaagctgaccttggtttcaaataaaaataaaatgtgtgccttacagtccactgggctctaagaaattaatttgtctttcaggcaggggctaggacagccttagagtaagggactcctgctgcttgctgcacagcaaggatgtctttgattcccttcacattgtttgaatcctgcaggcaactggaaaaggggagttctcacgacttgaagcaaggaatttcgctaaatgctggagctgaaagggaccttacagactttatagaccattttgtccatgttcttaaaatatttttctagtctagttcctctaaatctctcacactgtgctgtcagtacacaccacttgaaagcacccagtcttaacagcagatagttatggcttaacacctgcaacaataaagtcaatctataggtttacagatgctttttgcatgtgtacacatgaatatggacagaaaacaacactctggaacttctcacaaaggaatatatttatcatctaaggttacaaaagtcttataaactactgcagaaacagagtactactattacaagcagagtctcatctgtgcccctcctttaagaccctttttccatgcgttgtatgtaactttacccctgacttcatctttttgtcctatttttcctttcatcttcattttcccacttattttgtttttaatcttcctacactgtatatgtcactgtaatcactcaaatcctttttctgaaataaactaaggtttctgtatatgttaccagcagcaaaagtcattacgtttttgcaggcagtgaggaggaaaaaaaaaaatttattacatttttgaactgagaaaaagggaaaagttgaaaattaacaactatagggaggctgggcatggtggctcacacctgtaatcccaacactttggcaggccaaggagggtggactgcttgagcacaggagttcaacaccagcttgggcaacacagtgaaaccttatctctacaaaagatacaaaaaattagctgggcctggtggtgtacaactgtagcaccagctactcagaaggctgaggtgggaaaatcacctgagcctgggaagtcgaggctgcagtgagccgagattgtgttattgcattccagcctggacagctcacacctgtaatcccagaattttgggaggctgacacaggagaattgcttgagcccaggagtttgagaccagcctgggcaacacggtgaaaccctgtctctacaaaagatacaaaaatttagctgggcgtggtggtgtacacctgtagcacagctactctgaaggctgaggtgggaaaatcacatgagcctgggaagtcgaggctgcagttagccgaaactgttactgcattccagtctggacagctcacacctgtaatcccagaatttggggaggctgaggcaggagaattgcttgagcccaggagtttgagaccagcctggtcaacacaatgagacctcgtctctacaaaaataaataaataaataaataaataaataaataaataagccgggtgtggtggcgcacacctctggtcccagctactagggaagctgaagtaggaggatcgcttgagccccggaggtcaaggctacagtgagccaagatcatgccactgcactccaccctgggcaacagagtgagactctgtctcataaaaaaaaaaaaaaaaaaaaaaaaaagttaaaactataggactaaaacttttttttttttgagacagagcctcactctgtcacccaggctggagtgcaatgacgcgatcttggctcactgcaacctccgcttcctggcttcaagtgattctcctgcctcagcctcccaagtagctgggattacaggcgcccaccaccacacctagctaatttttgtatttttagtagagatggggtttccccatgttggccaggctggtcttgaactcctgacctcaggtgatccacccacctcggcctcccaaagtgctgggattacaggcgtgagccaccgtgcctggccaggactaaaactttaataccagttgttagtgccatgaaatgtgtcatcattgactttggcaaactaacaaccacctgtggacattccagcagccaggttattgcttcaccatctatcataaataaactgtgtaggctttaactcagaagaacgcatatgcacagaagtactgtgctttcaaggaccacttacttggaaagaatacagaatatcacaaaagagagagtactgtggcacagtggaaagatcacaggtttgttttgggttttatttcattctgttttttaattgaggcaaaaacacactgaacttgaatctaaccagcctctgatctagctaaaatttataagaaatacaaagaggaacaaaatatgtagaccaaatgagaacataatctgcaacacccagaaagtgggaagttatacagaacaaataagcaacctagcttcttcaataaataaatggcaaggaaaaaaagatgggagaggcgatttttatagattcaaagagatataagaaactattcactataagcaatctgtgacctaagtctggatcctgaattcaaaagacaagctaatgcaataatttgaggaaagctaaagacaaattccaatagagggcatcctacaatgtacctgagtggtactcctcaaaacagtcaaggtcataaaaaaagaggacagtctgagaaaccataacagccaagagcagcttaaggacacacaacagcaaagtgtaaggatggtatcctggatgagatcatagaccagaaaaaggacattaagtaaaaactaaggaaatctgaataaatcttggactttagttaataataatgcatcaatactggttcattgattgtaacaatgtatcacactaacataaatgctaatcataatgaaaactggggagtgttggggaggtaagggggattgagaattctgtacaacctactcaatttttctgtaagtttctgtaaatctaaaactgttctaaaaatagactattaatttaaaatatatttatgaaacaggcaaatatgaacattatttgatatttaaaaattattagttttttagatgcaaataatggaatgatatatatgtgtgtgtatgtttttaagtcttcgtttttgagtacttatcttttacagaaattcatggatagatggatggatcaagttaagaggggagattagagcaatgtttcccaaagtttggtactcaagatgatttttggtggtacatgaagattcttttaatgtttcatagctacatgtttaatttaaatatatattgtaaaaacataggtcaggcacagtgtctcacgtctgtaatcccagcactttgggagaccgagggtggcgaatcacctgaggtcaggagtttgagaccagcctgaccaacatggagaaaccccatctctactaaaaacacaaaattagccgggcgtggtggcacatgcctgtaatcccagttccttgggaggctgaggcaggagaatcactggaacccaggaggcggaggttatggtgagccgagatcacaccatcgcactccaccctggatgacaggagcgaaactccgtctcaaaaaaaagaaaaaaaaaaaaatacacacacacacacatatatacaggtagcacatcaaacacatgattttataggttttaattgcttataagtttcccttatacataaatttcttgaagctaaaaaaaaaacaggaagaagccgagcataacctatgcctacagtttcagctactcaggaggctgaggcaagaggatcacttgaggccaggagttagaggctgcagtgtgctacgactgcacctataaatattcactgcacttcagcctgggcaacataacaagacctcatctcttaaaaacacagagagagatatcattgtcaaaaaaacatgcaaaggttggttaagatcccaagtctaacactatgtgacctcttttgagaatttcgatcttgttgcccaggctggagtgcaacggcactttctcggctcactgcaacctcaacctcccaggttcaagtgattctcctgcctcaaccttccaagtggctaggactacaggcacgcgccaccacgcccggttaattttgtatttttagtagagacagggtttcactgtgttggtcaggctagtctcgaactcctgacctcaagtgacccacccgcctcggcctcccaaagtgctgggattacaggcgtgagccaccacgcctggcaatactatgtgacctcaagcaagttatataacctaagagtcagctgtttaaatggctggagaggtacaagacctgctatattaaaagagacatccaataaacaatagctgtgaaattactaaataaaaatcaacctaaaactccaacaaagaagccatatgccactagaaaagaatggagctgggagaacaaggaagggaaggaacatgagagtttacagaggcagtttaggcagaggcagtcaaggcttcccccttttcttctcaatctacccaaatgcagagaatctgctgctggccagccacagcctggagatcctgctgctcctgagcctcaggctctctcgagtgctgctggctaagatgtggttattacagaggtggggcctctagaacaatcagaagagtttttcttaccccatgctggtgtgagaaagagcacaggcattacagtaaaaatgaataagtaaaatgtaagtaaataaaatctatcactttgctatctacgtgaccttgggcaaaaattaatcacctccagttcctacttcttcccatgctaaaatgtggaaaacaagtctacctttcaaggttacagtaaaggttaaaagaaacagggggtgtaaatctggcaaacagtaggtatttaacaaatactagttctctcctccctccttattttggcaggatgacaagagaaactcttggtgaataaaagggattagggcgaacaaaaatcataaagaatagcatttccaaaagtgtgtctcttggatcacacagatttcgaaccaaatatatggggggaggaattctgggatcagaaagtttgggaaatgttgggaaacacattattaaaatgatgattatcaggtgagtttccaaaaggagactatatacagcatttactaacaactcacaggaataatcaacctattaatcactaaaacacatgaggatggaaggatggagagagggaggggaggaagggaggaagaaggaggggaaggcagcagttaaggccatgacaactccttcaaaatgatagttgaagtaacagtgagataaaactatctggacgacttacaagtcaacgacagttttaaaatctggtttagaaccagagaggggagaggggatgctttttcaacttctgaaagaagtttctgatgccaattatttaattttcaggatcaagtcaattacgagatggtactgaaacagaaaacaccaagagtttaagtagcaaatatactcactttggaagtagaaatagccttttgatataagatagtaattctcatttgctcttccaaatttattccctcattcgactgggcaactgcttggcaagcactgtgatagatgctgttatggattgcatatgtcctccaaaaagcatgtgttggaaacttaatcccaaatctaacagtgctgggaggtggggcttaatggtaagtgtttaggtcatgagggctccactctcatgaatggattaatgccaattataaaagggtttcaggctgcaagttcaatctcttgctctatcaagcaaagctctctcacgcccttccatcttctgctgggataatgcagcaagaaggcccttttgagattcaggtcccttaaccttggacttcccagcctccaggtgagctctaagacataaatctctgggccgggtgtggtcgttcacgcctgtaaccccagcaatttgggagcccaaggcaggtggatcacctgaggtcaggaatttgagactagcctgaccaacacagtgaaatcccatctctactaaaaacacaaaattagccaggtgtggtggtgcatgtctgtaatcccagctacctgggaggctaaggcaggagagtcgcttgaacctaggaggcagaggttgaagagagccaaaatggtgcagcctgggcaacaagagtaaaactccaactcaaaaaaaaaaaaagaaatctctggccaggcagggtggctcacgcctgtaatcccagcaatttaggaggatgagacaggaagatcacttgagcccaggagtttaagaccagcctgggcaacatagggagaccccaccttcacagaaaatttaaaaattagtcgggtatggtggcacgtgtggatcgcttgaaccctgcctagaaaggtgaggctgtagtgagccatgactgcaccactgcactccagcctgggcaacagagcaagaccatgtctcaaaaaaaaaaaaaaaagaaagaaagaaaagaaaaaagaaagaggaagagaaagaaatctctgttctttataaattacccagtctcaggtattttgttatagcagcacaaaacaaactaagacagatgctgggaatgaatatgccatgaactgaagatgacaaaacagatatgatcctcgcccccatggagattactttctaataagagctgattgtctagcaggggattacgcaatacatttgtgtatcagtccgtttcatgctgccaataaagacatacctgagactgggcaagttacaaaagaaagaagtttaactggacttacagttccacatggatggggaggcctcataatcatggcagaaagcaaggaggagcaggtcacatcttaagtagaatggcagcaagcaaagagagagaagcttgtgcagggaaactcccctttttaagaaagatcagatctcgtgagacttattcactatcacgagaacagcatgggaaagacctgctcccatgattcaatcacctcccacggggtccctcccacaacacatgggaattcaagatgaaatatgggtagggatacagccaaaccatatcaatttgtaaactacagttacattaacagctgtaaaaataaaaaaagaactgactgctgctagagcatgacaagggaacttaatctataagggtacctaggggacccaggcatggctcctaaggagttgacacttcagctcaactctaaaggacaagcagaggttaactagacaaggaagaaagggtgacccctccctaataatgagaacaaattataatgcttgttgtaaccctcaagcaggttcagaggaacagagaaaaagaaaaaaaaatcactgtgactcaagtgcagaaagcgagggtgaaaaagagcaaaaatagacaagactcaggaggaaaacagaggtgtcaaagttggggttactgactgatgcaaccaaaatcatcaaaggaatatcaaagtaaaagacaaactacattggcacttgaaacctgtccagtggtgccctccacatatataagttttttcaaggtatttctataaacataatacaggaaaaaactggacgagaaatagggttcagtgcatattaagaaataaaagcccacctgagaaggggaaggaattcccaacagaaccccacctcaaagcagcaaaggctagtagtaggagtgagagtccttgaagctgtcagtgaagccaacagcaactgatcctaaagtgtctcacagagagcatccagagccagagtctacgcagagaagggacccaatttccatttgccatggacagtatgcagagtgaggcaaacacttccacagctggcttttaacaaaaatggccatttcaatcacaaaagggcagcagcagtgccccagtcacgacaaaatcagaagttcctcaccctagtgatttccttccgctacactcccccatgcacctagaagcagcagagcagaactacagctaattttaacacttctctttcttcacaaaagaaatacgaatagccacaaacattagaaaaatacatccaatgtcactagtaacttaaatctttaaatctttaattaaactgagattttttgatttattaaaaccctaaaatggcataaacatgaagaaagcatgtttcatgcagagaatatagtctgtcatgtcacatcatgttcataaaggttaagaacagtgggtaaaacctttggctatatgaaatactcatgctcttaaaaaaagttagagaccatcctgtgcaacatagggagaccccattttgtctctacaaaaaccctatattttgtctctacaaaacttcaaaaattagccagtcatggtgttgcatgcctgtagtcccagctactcagtcaactgaggtggatcacttgagcctgggaggtcaaggtatgagccacaatcatgctactgcattccagcctgggaaacaaagaccctctctcaaaaaataaatatatacatacataatacatacatacatacatacatatgtacatgtatatgtatagatgaaggaagggaagaatacataccatatattaatagtagttataatggaaactttgttctttttccatcttactttacgtttttcattacatttttccatcttattttacattatatttattttcattttttctataataaatgtgaattgcttctgtaaaaaaaggtaagttcctattcaataattttgcaattattttttaatatatgtgtaaataatggtggtggactaactggttaacaacatgggggaaaaacgaactttgatccctaccgcaaccataaaaaacaattattttgagatagtaaaaccctaagacttgtttgaaagccttgttccctggtgccgtaaagaaatggcacttgaacataaatttaattttctcagcaaggccatttttctattttctgcagaaagggtacactcgccagcagcttagccacgagagtacactgaacaaacgagacagggtcatttataacctgacatgtccaccctactgccgtgtccagtttcaattggctggaacaggacctcacattttgtatttgtcccgattggctagcaacttagaactttttaaaagaggcaaaggcagaggagaacaaaggaagaaggaagtaacttgtggaatgctgagaaaggtaaaaacaccttcaaataaggaagaggaacaggctatgacctaatgcttgcttggaccagtataagcatgccagggcaaatacttaagctaaattgtgggagctaagaacataaagtatattgatttctttattacagctagcagatatttaagaatgatggtacaggtctttgaataaattttgcttttaagagaagttactatttattcctaactagatggggaggaaagtctttgaagacaaacctctactttactttttacagacttctagaaataaataaaattaccttgaagaccttaaaatttatcaaacaggacatgaaatacagtaaccatgaaataaaaaattggacttcattagtattaagacctgctatccatcaaaaaacatgattaagacagtggaaaggcaagccacaaaacaggagatgtctgcaatatacgcatctgacaaaggactaatttccagactataaaaagactcataaattagtaagaagaaaactcaattttttttataaagtcaaaaaaggcgtatctctaaaaaggatattcaagtgggcaataggcacatagaaatgtaaattaaaaccacaatgaaataccatttcacacctatgagaatggctaaaattaaaaagactgacaatgccaattgctgactaggatgtagagcaactaaactcatattgccagaggaagtataagaatgtacaaccactttgggaaaagatctggcagtttcttgaaacacaaaatatacatcttgtgacataagaaacatatatttgatctttgctgccctgatgacccccattactggcacaaaagcgaaaattcttggaattgcctgagtgatagtattgagaggagcatcttttgttattcaaaataagccactttcaaccatactagagtttatgctaataaggtgactcttggaagatgggggctggctgctagaggaaccatgatccaaattttcactgcccccaccaccatctccgggaaaaggaaagggactggagacgggagaggagctaggaattgagttaatcaccaatgcccaatgattaatcattaattaatcattaatcattcctaggtaatgtgacctccattaaaaaaaaaaatcttaaagggcagggttcagagaacttctgggatggcaaacatatgcctctaccaggaggatggtataccccaacttcacagagacagaagctcctgcacccaggacccttctagaccttgccctacatacctcttagtctgactattcagttgtatcccttataatgttctttttaaaaaccaataaatgtaagtaaagtatttccctgagttctgtgagcctttacagcaaattactgaacatgagcaggtgatcatgagacccctcaagttataaccaaaagtaccctggcaacttaggacttgtgactggcaccttaagtgggggcagtcttttggttaatttaagggatctcactagctccaggtaaatacagtcagaattgaattgaactacaggacacccagttggtgtctgcaaataactgaagaattgctttggtgtggaaacaaaaaacatttggagtcaggaatgatgttagcgtatagaaaaatagtttgttcctttacatttactctatctcagcaatccactactaagtatacccaagagaaaaaagatgtcctcacaaagatctgaatacaaatgctcacccaagttttattcataatagccaaacgcaggaaacagcctaaacatccatcagtagaattggtaaacagttatatactcatataatgcaatgctactaagcaataaaaaggaatgaactgatacaacaagaatgaatctaagataagtcaaacataatagagtgcatacagtatgtgcatcttgtatgattccatcttatatgaaattccagaacatatttaactaatctatagttatagaaggcaggttatttagggctggggcagagaaatgactgaaaaggggaacagggaagttttttggggtgacggaaatgttccatatcttgatagcagtagtggttatgtgagtatatatatttctcaaaactcaaacagtacacttaaaatgagtggattttattgaatgtaaaccataataaagctgattaaataaaaaacagaaaccacaatacagatactaccacgcacccattagaagggttaaattttattttatttatttttatttttatttatttatttatttttttgagacagagttttgctcttgttgcccaggctagcatgcaatggcataatctcagctcactgcaacctccgcctcctggcttcaagcaattctcctgcctcactcagccttccaccaagtagctgggattacaggaatgcaccaccacccagctaattttgtatttttagtagatacggggttacatcttgttggtcaggctggtctcaaactcctgacctcaggcaatccactcctaaagtgctgggattacaggtgtgagccaccacgcccagccagaagggctaaattttaaaggactaaaaataccaagtgatggctagaatgctctacattagagatggaaccaactggagtacagacatttagaagacagtttagcagtgtggtgttatgacacatacatactggttttcatccaatgcagcaaaactcccacagcccttgttacagtgttttgttataatgttaggtaagttaggcctcaggaaacggaatctcggtgaccttctccagccctcctttgacctgacccgaggcacgactctaatctttaagatcctctgcagagagggtcctgccttataccccaggggaaggcatgccgatgtcatgaagcttccataaaaacctaagatgtgagcagtggctcattcctgtaatcccaccactttgggaggccaaggcaggtggatcagttgagcccaggagtttgagaccagcctgggaaacatggaacacctggtctatacaaaaaaatgaaaaattaaccgagtgcacacctgtgatccaagctactcaggagactgaggcaggattgcttaagcccgaaaggtcaaggctgtggtgagctgtttgtgccgctacactccagcctaggcaacagagcaagaccgtctcaaaaacaaaacaaaacaaaaaaaccaagaggacagggttctagacagatgaacaggtggaggttcctggagggtggcacactcacagagggcatggaagctctgccccatacctcaccctacacatctcttcatctatatcctttgtaataatatcctttatgataaactggtaaatgttacctgtttccctgaattctgtgagcctttccagcaaattaattgaacccacagtatgggtagcgggaaccccaacttgaagcaagttggtcagaaggacaaaagcccaggcttgccactggtatgtggggtaggggggcaatctcggggaccaagccctcaatctgtgggatcggacactatctctaggtagattgtgtcggaattgaattggggaacacacagctggtgcccgctgcagaactgattgctcactagtggtggagagaaacccactcccacacatttggtcacagaagccttcttctgtgttcatgactgctgttgtactggtttgagagcagaggaaaaacatggtttgagagtttttcccaaaacaagcagtatctattaaagctaaatatatgcctacccccattacccagtaattctgttgggttctcatacccaagagaaacaagtgctcatgtctaccttagaattgctgtccacagtagcagacaaaaattagaagcaactcacgtattcatcaataacagccaagtactcagcaacccaagcatttcatcaaccaagtaaaacaaacaaactgaatatttacaatggaataatgcatagaaaaaaaaaaactacagccacacataataaaacggatgaattttacagacataataataatgagtgggggaacaaaaccacaagagtatatactctataatcctatttacataaatttcaaaaacagacataactagcctacagtgaaagaggtcagaaaaggcctttaagaagagagttcattgactggatgagctacaggcaagaggaagccttgaaatgctctggaaaaggtctataatttgatctaggtagtggttacacgatgtgctgtgcacacatgtaaaaattcattgagctgtacacttaaaacatgtattctttaatgtaagttatacacaataaaacatacctatacaaatgctcttttaaccaatctctgtttatcctccaaagccggaagcttattacacagtagccaggcatggcttgtcagtcaatctcacttctagtctacccatttacatgtacttcatgtctatctccctcagcatgtgtgggctggaggtaatactaaatatccagaataatggcaccggtaatggaactagataaagtcatgctccaatcagggagaatttctgacaaaatagttataaacagtctagatgatcataatatggtataattttaagtgtgggggaaaggaccttatgaattcactatccttttaacttctagtagcgattgtaggaaaattaaatacatgcagcaagctccttaaaaataagtatatagctttccaatcttgtttaaaaatttagctccataattataaggaaaattatagaaaaaaagaatcgcactataaatatttactttatgcacaattttcaaaaataaaggcaggtcgaagttacattttttgcagaagcatgttatttgcatattataaaactaagctttacggtgacgacatgcctaaaactattactactgccttccaaaattaaccaacaggttataaaaacaagcagttaactttcagacactgatttatgaaggcaaagcttttcagaaacaggactctcttaatagtctgatttacattcatatcaatacaaacacacatatacgcacagctatcaacacagtcatccactctacatctaaaatgtctcatttcctcctcttcataccatctgttactatctcatctttccttccctgggacattccaacagtaaatgaatcagtccccctgctccaatttgccctgctctaaagcatcctctaatctgacaactggagtgatctttgtaaaccacagatcttgctctaatgttcacagtcacctcccttctcaaccacatccaccaccctcatacctcctccaatctaggcagggatcacacgctcaaaaacttacatgtggctcacacctgtaaccccaacagctcaggaggcctgggcaggaagattgcttgaggccaggagtttgagaccagcctgggcaacagtgagacccagtatctaaaaaaaattataaaaatagaccagatgcagtggctcacacctataatcctaacacttcaggaggttgagagataaggatcatttgaagccagttcaagaccagcctgtgcaacacagcaagacttcgtctctacaaaaaaaaaattaaaaaattaaaaaattagctgggcatggtggcatgctgctgtagtcccagctacttggaggctgaggtgggaggatggcttgagcccaggaattagaggctgcagtaagctatgactgcacctctgcaccacttcagtctggggaacagagcaagaagaccctgtaccgaaaaataaaatatgattttaaaacttagccagacatggtggcatgcaccagcagtcccaactacttgggaggctaaggcaggaaaatagcttacgtccaggaggtcaaggctgcaatgagccatgatcacaccactgtactccagcctgggtggcagaacaagattctgacccaaaaaaataaaaattaaaaatgtatatgaccaattagataaagtgaaattggtctcataggagttacgtacaggaaagtacaagctctgactcaaaaggacagctactactgagctccaattttcaaacaaaaccacaaattagtgttttcatatgaaatgtcccaatttttaaaatctggccaggagcggtggctcacatctataataccagcactttgggaggccaaggcaggtggatcacttgaggccaggagtttgagaccagcctggccaacatggtgaaaccccatctctactaaaaatacaaaaattagccgggcatggtggtatgcacctgtagttgcagctactcagaaggctgaggcctaagaatcacttgaacctgggaggtggaggttgcagtgagatcacaccattgtactccagcctgggtgacagagtgagactctgtctcaaaaacaaataataaataaataaataaaatccgtgtggaccaggccaggtgtggtggctcacccctgtaatcccaacactttgggaggccaaggaggatggatcatctgaggtcaggagttcaagaccagcctggccaacatggcaaagccccatctctgctaaaaatacaaaaattagccaggcatggtggtgtgcgcctgtagtcccagctacttaggaggctgagataggagaatcgcttgaacctaggaagtaagggttgcagtgagccgagatggcgccaccgcactccagcctgggcaacagagtgagactccgtctcaaaaaaaaaagaaaaaaaaaatccgtgtggaccacataaaatatgtttgtgaagctctacctatccacaggttattagcttgcatcttatgacataaagcagggatccccaaccccaggctgtggactggtatcagtctgtgacctattaagaactgggcctcacagcaggagatgagcaggaggcaaagctttatctgtatttacagctgtcccctaacactcgcattaccacctgagctctgcctcctgtcagatgatcagcccaggcattagattctcacagaagcaggaaccctactgtgaactgcgcatgtgagggatctacgttgcatgctctttaagagaatccagctaatgcctgatgtctaaggtggaacagttccatccccactccccgtgcctggtctgtggaaaaactgtcttctaggaaactggtccctggtgccaaaaaggttggagaccaatgacctaacgggataaagttcaagatttagttataacctgccttttcaaattcatcacccatactcccttccacacaagcaatactccggcaatacacagaattacttacttgtctcccagatagacaacaaacaccactgtctgcaaaccgttgttcacttggttccctttgctatgaagctccactatcccaatacatccatgtttacgtctaacttctgctcgagcctcaaagggtaagtttttttgggttttttttgtttgtttgtttttttgaggcggagtgccactctactgcccaggctggagtgcagtggcacaatctcagctcactgcaacctccacctcccgggttcaagcgattctctttgcctcagcctcccgagcagctgggattacaggcacccactaccatgcccagctactttttttgtatttttagtgagacggggtttcgccatgttggtcagtctggtctcaaactcctgacctcaggtaatccgcccacctcagcctcccacagtgctgggattacgggcgtgagctaccgcgcccggccaagggtaagtttttaaaatatcccttatgaaatttccttccttttctaactcctacaacactgtttgtctacttcccgtgatccttacaagttttcacactatggtatacttttttatgtaaaagactacaagcttctggaagcaaggtatgcatttgattctgttctgtattccccaaacaatacctagaacagagtacatgctcaataatgaatggatgaaactatttatctgcctatttaagtaacaatgtgtatctcaatttgatggggccatgataccgacaaggtcccttagatttggaaaattaaaaggctaacagagtcagaaaaaagtctctctaatattacatctgaatcagaaataacatgaactcacggttctttttaaacatatttcttagttctgtccactgaaagggtctagaagcaatgacaacccatggcaatgattttagtttctaaataccattccttactaaaaagaaccagagccttggagaaatggctgattcctgatcaccttatggaaatataaggtgagtctgggacatcttgttgtgccaaaaaagccaagggaaaacaaacaaacaaacaaaaaaaacagtgatggggtcatgtcaaaatgaaacaggaggagctacctagaaaaagttatcagtagccaaacctgagacaatctgagcattagcaaagactgtaattgattgttaacactgaataaataaaagtccaggagagtatggtgatataaaaaaggaaggaagaaaaatgggggcagcctgtgggagtggcaatttaaaaactacaattctggcacggtggctcacgcctgtaatcgtagcactttgggaggccaaggcaggcagatcacttgaggtcaggagtttgagaccagtctggccaacatagcaaaatcctgtctctaataaaaatacaaaaattagccaggcatggtggcaggtgcctgtaatcccagttactcaggaggctgaggcaggagaattgcttgaatccaggaggcagaggctgcagtgagctgagatcacgccactgcactccagcccgggcaacagagcgagactccacctcaataaataaataaatatatacatacacacatacattcatactacaattttggcccagcatggtggctcacgcctgtaatcccagcactttgggaggccgaggtgggcgaatctcctgaggtcaggagttcaagaccagcctggccaacatggcaaaaccctgtctctactaaaaatatgaaaattagccgggcgtggtggtatgcacctgtagttccagctactcaggaggctgaggcaggagaatcacttgaacccaggaggtggaggttgcagtgaactgaaattgcaccactgcactccagcctgggcaacagagtgagactctgtttaaaataataaaataaaaaatctacaattttgcaacccctattgtaataaccgatttcaggatcaggataatgaaaccaatgagtgaaaggctgtaatgaaacagggtatttacaaggtgccaaaatagtgtcccatagattcctctctaatagcagaagagaaaattttaccttcattatggagagatctggctgcgccaaggaatcaaagttagcattgctcataacgggataacccgtcattaagtgcctcctgatatgactcaatgtgaactgcacttcacctatgatgaagcattctcgtcaaaatgtttaacctggatgcatctcaattaacttccagtttacaggaagtagaggagctagagaaaccagttaaatgacaccacgaggaaataatgaatgcacaaggttacacatcctacaagacaaccagagctggtctcttcaaacaagttaatgcaggcaaaggaaggaaaagggtaaaggaactgttcttaaaaaagagtacaagaaacataaccaaatacaaaggatgtactttgtttggatcctgttttgtcggtttgtttgttttaaagaagtgagagtggtatcaaagacattcttgagacaattaggaaaatttagatttaattgatgcttgatattatattatggaattactttaattttcttagatgtgaaaacagtattgtggttacacatgcataaagtatatgtgattatatataatgtggttgtatacacggagatatggttgtgtgtatgcatgtaatggtttgagacaaagagagagaaactatccttattttaggagatacatgctgaaaacttaggggttaagtattatgatgtttgcaacttactttcaaatttttaacaacaaaaaagggaggtagggaggaaggaaaagacagagtaagagagggaaggagaaaaggagagaaatgggaaggagggaagaaggggaaagaggaagagaagggaggggggtagcagagaaatgactcaaatatgacaaaatgttaacaattgttgaatctaggtcaagagagtatataaatgttatacttttttacctcaactcttagatgtatatgatatttttcataataaaaagttaatggaggaaaaagagaagaacaatttaaaaagcaaacagtttaaaattcatgtaataccatgagactgtcaggaaataagagcactgttactcaagatctgtgagagtataaattgctgcaatgtgactggagggcaatgtggcaatgtctatcagatttataaaagcacctagtcagtatgcccaagatcctgtcctgaagataccttccatatgcacagttcttctttatagcattaactgtaacagcaaaagactagaaatcatctacacatgcatcagtccaaactggttacccaaattatggcatatttgtacaataaatcagcatgtatcttttaaattaaattatctcctcaaaaaatatgacagctctttgggaactgatatgaaagataactgagtcatattttacttaaaaaaaggtgcaaaaataatgtgtacaggatacacgtatgtatagaaaggttacacaagaatgtagttgggtggctagaaggaatgagaaacttttttttttcgctggttactcccttttgcactttttgagtcttgctctattgcctgggctggagtacaatgacacaatcttgactcactgcaaccccccacctcctgggttcaagcgattctcctacctcagcctcccaagtagctgggattacaggcgcatgccaccacgcttggctaattttcgtatttttagtagagacggggtttcatcatgttggtcaggctggtcttgaactcctaacctcaggtgatccacctgcctcagcctcccaaagtgctgggattaaaggagtgagccatggcacccagccccttttgtaccttaattttgtatcacagatatagtaattcattcaaaaaatttgtcgagtattgattgactgtagctataatgaactcttcatgtctccatgctttcactatcaaaacttagttacagtggagtcgcaggaggcctaggaattagggtctgaagtgaatatgtaaggtgaaaatagcatacgacaaaaatatgcctcaaaaatcccttaaggatatgccatacttgagaccaacacagcatctcaataattctaacaccactaatttttactccagcattggaacagttcacagtttcttcaactgactagcagataaaatagctggcttgtatttaggcctcacgttgtgatgttaaaagtgtgtgtctttaaaataccataagcacacatatcacagcaagctaaaacgcactcaggactcaagacagactgaaagaacagattcccatttcccatcttaacgtttgatccacagtcttcactgttcaggttctgtttctcttatttttgtcaccagatgcataaaatttgagtttgcataaatgtacataagatacgttctcaaaaacacatttcaaaaattaagcaaactattacagtagaagagaaagtcacaacccaaatgtttgctgactaggagtaagtaatagcaggctgtaacaaaattctcaggtcaagatgaaaaggagagggtgtggccgggaggttggctcacatctgtaatcccagcactttgggaggccgaggtgggaggatcacttgaggtcaggagttccagaccagtctggccaacatggcaaaaccctatctctactaaaaatacaaaaattagctgggcgtggtggtgcacgcctgtagtcccagctactcgggaggctgaggtgggagaatcacttgaacccaggaggtggaggttgcagtgagctgagatcgcaccactgccttccagcctgggcaacagagtgagactccatcttaaaaagaaaaaaagaaaaaaaaaaaaaaaaggaggccggatgcggtggctcatgcctgtaatcccagcacttttggaggccaaggcaggcagaccacaaggtcagcagtttcagaccagcctggccaacatagtgaaaccccgtctctactaaaaataaaaaaattagccgggtgggttggcatgtgcctgtagtcccagctaccaggaggctgaggtgggagaatcgcttgaacccaggaggcagaggctgcagtgagccgaggccatgccatgacactccagcctaggtgacagagtgagactctgtgaaagaaaaagagagaaagggggagagagagagagagaggaagaacgaaagaaaggaaagaaaggaagaaagaaaagagagagaaagaaagagaaagagaaaaagaaaaagaaggaaaggaaaggaaaggaagagaggagagggtagtaataacacctcttggtcaacatgacatatgatctcaggttctgaccttagctgtagcccattcctttatgttgccattcccatacaccaatacatacattcttcagtctatactctgagtaatcatgtaactgtactaaagtctagtcagctaccactgcacctaaaaactccccaatatttctctctaaccctgccctctctaatgaactccaggccaatattcctactagatacttctcttcttagacaatccatccataggcaactcaaattcaccataacccaaactgaactcactttaatataaagaggccacaaggaagcaaggaaaattcaactgttttctcagagttgaaaatgaacacaaaatggattacagcagtgataaaggaaccttaaggaaaacaaagggcttcccaaacctgtaagtcaagtgtgcattcaagctgaatgtactaatctgtctaaaaacaaatgccttaatcataaaaggatctgggaagcaaaagcaagcagaagaggtgaacgaagaggctttaccacagggaaaaaccaccatccctaaaagtaagctgaatgagggtgtctcagtcccaggccaacagacgtcttacttccctgatggagtcttcctatatgaagagaatattccagtcatttggcttgagtcttcaggtctctctgacttgtttgaaaaaattaaactagcatattaattaggacctagtaagtaaatctgcctatcaaaaaacaatatactctgggtgtggtggctcacacctgtaatcccagcactatggaaggcccaggcgggtggatcacaaggtcaagagatcgagaccatcctggccaacaatggtaaaaccccctctctactaaaaatacaaaaatcagctgggtgtggtgatgcgtgcctgtagtcccaactactcagaaggctgaggcaggagaatcgattgaacctgagaggcggaggttgcagtgagccacgatcgcgccactgcactccagcctggtgacagagcgaagactctgtctcaaaaaaaaagaaaagaaaagaatatactaatcatgccaacacacatatcactgtaaattaataaattaaaatttaggttttacacatcagtcttgtaaagttggttaatgttggtccaaccctgggataaggggatgtctaggcatgctgagcagatcaaatttctgtgagtgttaaaccaaggaccagatctaggatgatggtaaattataaatctccacatgtagctatttaaatgtcaatttaattaaaattaaaaattcagttactttgagccacacttcaaacctctaccatattgaacagtgcagacactgaacatttcaatcattgcagaaagttctatgggacagcactgtactaaaaggtaacctcaaactaacctattccaagttgccttaggaaacagcctgacagcccgagatggctaatgcagaacctgagagctagactgttttctacagaaggtaagaaatatataaaactgtttccttttgcaatgatttcttgaaatcagaatatatagttttagtctttaggatttctgcccctttatcactggatgatactctaatctacaggtaatatagaacagaggtaagaagcacattctctgaagccagactgcctgggttcatatctcacctttgtcccttacaagatgtgtgacctaaagcatgttatttaaccactctaccctttagtttcctcaccagtaggggggaaataatggtacctacctcattaggttactacaggttgaatatccctaatccaaaaatacaaaatccaaagtgctccaaaatccaaaacgttttgagtgccaacgtgatgctcaaaagaaatgctcattgaaacttttcagatttcagattttagattaggaatgctgaatcagtatacagcaaatatttgaaaatctgaaaaaaattcaaaattctcaacacttctgatcccaagcattttagacaagggatactcaacctgtataaggataaaaaaaagtttatatgtataaaatatctagaatcatgctcaataaagaataagtacccagtattaactattacttctactactagtaccattactaccaccaccaccaccaccaccaccagactgtcctgactatccttcagaagacaaagtgaaaaatggctcacacctgtaatcccaacacttcaggaggccgagtcaggcagattacttgaggcccggagtttgagaccagcctggccaacatggcgaaaccccatccctactaaaaatacaaaaattagctgggcatggtggcacgcacctgtaatcccagctacttaggcagctgagataccagaatcacttgaacctgggaggcaaaggttgcagtgagccacaatctcaccagaggagaaatattagcaaatgtgaaagtattaaattaaaacaaggatcacgaagtcagaatgtccgtctacaataaaaagaaaatttttttaagatgaaagggagtaggatgttctccagaaagaatattaaataccgaaaaaagtcatgttttcaagaatgttgcctgacaatgccttacttgtaaggatgacaaaccacaggccaaaagaagtctacataatgaactactgagctatttaaataataaatactgaggaggaactgagaagatataggtttgagttcactggaccaaatgatacttccctgtataaagcacatcttgatatttaaatgcattgtctctcctatactccctaaattacctttacattcacttgatgaactgactgaagatctgatttttcagtaagcaagcatttaatcatattaaatgggctgggcgcggtggcatttaatcacattaaatgggccaggcgtgatggctcacgcctgtaatcccagcactttgggaggctgaggtgggcggatcacaaggtcaggagatcgagaccatcctggctaacacggtgaaaccccatctctactaaaaatacaaaaaaattagctgggcgtggtggtgggcgcctgtagtcccagctacttgggaagctgaggcaggagaatggcatgaaccagggggcggagcttgcaatgagtggagatcgcgccactgcactccagcctgggcgacagagcgagactccgcctcaaaaaaaaaaaatcatattaaattattaaaataccatgccaaacaatgacccaccatgtgttctttgagtggaaacgtgttgtagaaaatcacaccttgctcttgcagacaggcaatttgaaaatctaaaggttaaagtacaaacttcagcaagtgtagtaagacagaaagagtcagagctttgaggacacctaaacccaagcttaaagcttggttctaccatttactagctgtatgacctgagtaactggcagtttatgcttacgagctccatttcactagctgtaaaatgcaggtgaagcattgtgccaattaagtaatatatgtaaagtgcatacaagggtaactggcatgtagcactcgctctcaataagcagttgctacagttagtaaacctccccaagacgacctgccaagagacctcagaataaaatatcaccactttacatgaaaccgcaaaaaatattttgaccaggtattaactattatataaatcatgtgagaatgcctcaaagttaccatttgttttccatattttacaagctattccctaaacaacatatgtctctgtttactgtatttcctattagactatgaataaaaactatttgggcttacaataaaaataactgagttaggcgtggtggctcatgtctgtaatcccaacactctgggaggccaaggcaggcaaatcattcgagcccaggagttcaagaccagtctgggcaacatggtgagaccctgtctctacaaaaaagaaattagctgagcatagtgacatgtgcctgtggtcccagctacctgagaggctaaggcaggaagatcgtgtgaggccaagaggtcaaggctgcagtaagccatgtttgtgccactgcagtccagcctgggcgacctgatgtctcaaagataataataactgcacttcttacagtaaaacaaagtttttaccaggaattcagacacatagaccttcactgatccacactcaaacatggccaaacatgacactacgcacaaacgtctaatatttctccctttccctattaatggacaaaataaataagggaaaatatttttcaaaatttctttcagcgagttgagttccacaaaacaaaacaatacagggtaattgcttacctggaaaatattttgtacttcagatccaccaatccagaatgaatgggggttttccctttcagactagtctgagaaaagacagcagtcaagcatcttccaagattctttccgtttactgtatccagctttcttcaacaaaatcccaaacatgcacttcggtaactgttgaaagacagaaagcaatccatacacccaccatggcaccagcggcaaaggacagcctccaagaaatggaaggaagggtcaatggaatggtggatctgaggcacaggaaaaaagttataacccctgagtcagctatttggcataaaatgcctgcagcagcattcctcacctctgtgttgaaaggatacaaaactcgtaacaaataatggaacatccctaatgttaatatttactcatgataaacagcatgcaacttccaaatgagagcagctaaaaaatacctaccctatcatccatataaattgtcctagaccattcagctacactgaacttccttatccattttctaagacagctcctccaccattagaaaaatagtttgtcagccaaaaagaatgatacgagagggctcaaatatctaccataaagatatttatttacgtacctaacaaaatgttttggtttgctacatataagacatcatatctacatattacccaaatcctctacccttagctaaaatatagtgtgcttcaaaacatataactgaagactgaacttctgactcagtaaaggccagtcccgtacaatggccaatgatcacgtaaactgggaaaaatcataaagaacgctaatatacaatttactaggtgacaccattaaatattaagtcctgtccatattatatcaatattctttttctaccatatcaaattagactgcaaattctaaacaaactaaaagggaaagagaaaaagcattcagcagaacaacaaagataaaaacaaaaagactgaacttactcgaacataaatttgctacttccacaattgctacattatagccaaaatgctcctgcagtaattatagtaatacctaccttattgaaaagctactaactggccaagccctttacattaattacccatatttaattctcaaaaaaagatgagcagaaagaagtaacctatccaaagtcccacatctactaggtagtagagcccatgcccttttcatggagcactatggactccacagttcaagggtcagaaagcccatgatttctgagagaggagaagaaatcaagctttactctcaaaggtcctaaattaattaacatcaaaatggagaacaatgaaaatacagaagagtaaatatttcagcctacatgaatcagttgggccatcctgaaagggtaattccctagatcttgccacttaaaaaagcatttaattaacaaagagccatgcaattctacagcccatgatatttttttcttgtctttttttttttttttttaagtagagacagggtttcaccatgttgcccaggctggcctcgaactcctaagctcaagcgatctgcctaccttggcctcccaaagggctgggattacaggtgtgagcccccatgcccagcctaaagcccacaatattaatgctaaaacaaaacacattataggctgggctcgatggctcacacctgtagtcccaacattttgggaggccgaggcgggcagatcacttgaggtcaggagtgtgaggccagcctgaccaacatggtgaaaccccatctctactaaaagtacaaaaattaaccgggcctggtggcacatgcctacaatcccagctactcgggaggctgaggaaggagaatcacttgaacccgggagacagaggctgcagtgagctgagatcgtgccactgtactccagcctggttaacagagcaagactccgtctcaaaaaaaaaaaaaaaaaaaagactgtggcaagacatactataatggtactcaagtagtctttgtgtttagcagcaaagattgtaactgtgacaaagaatctcaaatccagctgaacccaagtaatttttaaattctaagatttgttgacagtccacaggcaatgactcttaaagatgttctgattgttcatattgtaggtaaggcaattaaagtgactgaaataccggtctatgattaacctcgccataacaatcagatgaaaataccttaagactcacaactttaaggagatcacaaaagtaaaatcccaagcaaataatgagttctcaagtttttcccattaagtggtattactcctaagcctaagaataaactggaaacccaattttgacagaagtagctagggaactatggctagtagcgaactgctaaaacagtatactatgcttttcaaggtacgactatccaaaatgcaaaacaagttatagcaaaacacaaccacagcaatttgactaacagactcatttctggacctcttgaatcctcaggcttttcccctgtactagtgagttaatttttctcccttcccttcaaaaaaaaaaaatatatatatatatacacacacatatatatttcttcaatccctaattgtatatatatatttcttcaatccctaattgctggcaggccttatgctagtaatacaaagattaacagatgccaggtgagtagtgtcaggactgagttcttcctgcccctctgccccctttctctttgaatctatcatgtagtcatttcagagggccaaaatatattttattgttagttaccaaaactggttcaatgttctccagttaactcctaaaaaaataaacattaaaaattactcaagttcctttttcacaatagtagaacctcagtctttctttttcttctgtggatcagaggctttttactatacaatggtttcctacattcaatatgcttatatttacacacctctctatcacaagccaaagagccaaagcttttttttttatttttcctattaatgtcccagtgtttatacttcacagctttccattttgtgaagctcttcattgttaactcaacctgagagggaatttcctaaaaacgcttcccgctgacatcacagaactcttccatcttttagtttcattaaaacactaagaaccaggtaagagataccctactggattgtcaggtcttcctggtctgtctctcatttgcctacaaagacaaacttcctcttaagcaattgcgatcagcagaaactaaccaagggtaacgagcacattcttaaccaacacgtttcttcccccattgtcatctaattcaatgaacaatacaactcagaagaaaatcttgtatgaattctcactgcttattctgttaaggttaaaaccatcagctttgatgatggtaagaataagaattcaaaaaccacaatttggtcagtctaaactaaaccgatcaaacataaatcccaatgctcaatgtcaatataaactaatcaccagtctctttctgtcaggataccaggcataaaaataggactgggtgggttctctctgtagttacagcatagatctaattacgccaaattggtagtcattgaaatagtacctcccagattttccaagacagtattgactctgcatgatttcattgtttttcccaaagatggctcattaaatgtatggctaaaagcaactaaatgttagtcttctgtaaagcctcacaaataaatacatgcgcaactcaggagaaagaccttttccacaccatcggtcttgacttcgctttagggtccctgtacttgtggggaaagttagtatggtcagcatttgaagaaaagcaagcctctgcaaagtcctttcacacacatctctcatataatcctcccaacaactcagaccaatacctaagttttcttatttatttttacatataatcaaatcatactgcagaaaggttacctttctttatgtcacacagctagcaagcgacagagcttggatacaaactcaggtgtttcacttcaaagcccatgccctttctgctaaaccatgcttttctaaggtcatggagcccttggagcttatcaactatttggcaaacctgcaccaactgatgcaaaaagtattcagtttcctcagttctttgctaacaaccagtctctgagttctatgtaaatcaatctgtatgtgtggaaagtctgtaaataatggttaatatgtctatggatgtcctataaacaacacaccacccacctcttccccctccccatctttcttctctattcatctctacctttgtcttaagatattcaaaaggaaatcttaaaaggtttcactgcatgaaagaaagaaaatctaacattaatttaaatccatattgagcacccatgtgctgaggagtaacagggcaatcaaacacagcctctagaagaagagtttaggcacaaccacaagtttttataatataataggatgatatgataagtcccataaaaatttggaactgattattgtgagaattagtaatgtgggtgaaaatgtttagaaaagaggatagttaagacacaggcaaaaggcaataatgtctgaaaatgatcaccaggaaaattcaacccaacatttcctgaaagcctaccacaaagaagacaccgtgtgtatgaaggaactgtgtgtcactggaagataattaaggtcccagcccttcccatgaggagtttatcattcaacagaggacacaaacaggtaactatattacaagcctgaaatatgttaagtgctacaggataaatacaaagtgccagaattcattcatttcatttgagtgtcatataggcagtgctatacagacacaaaaaccagacagtctctgctaccataatataaactgacatcaaaagaggtggcacctattgtgttttatgggtggataggacttcattagcataaatgaaagagaagattgctgagatataacctaagccaatttggccagagaaccacctattagatccttttgataaatatcagtagccttcaataaatgggcttaggtccattcctatcagtgctgacaaaggaaacgtgtgagcagaatctggaggaccatggtcctccatgtgctagaatatacagtaagcaaggaaagtaggcagaaaagccataagggagaatggaatacaaaggaagactggaattggaatcactaggacttaaaatgctttgttttctatgaagaacaaatatcacaaggtagaacccaggatcccacagatcttacagggcagataattttgtttctagaattcacaggctcaaacaacactagtaagaggcatatatgtgctgttgtgaatctatgtaatggctgagtgattctcctgggctagctccctatttgcaggagacagactatagcagtcaagagcccagaatgccaagacttgtgtgcaggaacatgtttatccatgtcaaatctgaaaggatatctaacctactgcaaaatcaggggcaaaaattgatatatttgagccaatgcctctttaggcaggtcagtgaggtccatatattttatataaatgtgtgtgtgtgtgtgtgtgtgtgtgtgtgtggtttattcatttggaccctattgaaacctgtgtccactgagtctgcattcagtaagttagcacccctagtggtgtgctacatgaggagaaaggtggtgacaaagtaatatccaatttcttgatgaagtcactaaacaaccccactcaccccgagaaagtcaatgacaggaagaaaaaaaaaagatccaaaaagaaaaaaagacaacatttccagtaacttcatttattcgtttctttcttttttcttttctttttttttttttttttttttgagagtgtcttgctctgttacccaggctggagtgcagtggcacaatcacaggtcactgcaacctcaaactcctgggctcaagcaatcctccccacctcaggctcctgagtagcagggactataggagtgaaccactatgcctggctaatttttttattttttgtagagacagggttttgttatgttgcctaggctggtctctaactcctgggctcaagcaatcctcccacctcctaaagtgctgggattacaggctagagccaccgcacctgcccacaccttcttaataaggatcagtgtattttaacctacattacttcattgaacaagtaatacagccacttaagagataagacagaagggaaatgactcacttaaggtcacttagcaaaaagggaagtcatttaacaattaattataaaccatccattaattgtgtaaagggaagaggggattcactcacacccgtggaggaggcaggatcgcctttcctaaagtgatagcatcaatttctgctggcttcttacagggtaatctaatcatctttctcttccaatcagaagctcttgtgagtgctttctagtgatgagtgcctgaaaatcaagtcatattcctaactcaaaggttaataaataccacgtgatacatattgtacagttctcattcttcccaatgaagtccattgaacatagccggataaactttacatatttccaaaatgaattactagttttctgcctcattcataaggcgaattttaccaaactcagaagtttggaaaaataggcccactaacaggtatagccctgggccaatataaggccctaaaagtcatctggcggttaaattatttaccattagtaactgtaaattcagggtctaaattaagagcttatagactttactaatattcaaagctgaatcctatagagtgggtcaggaggagaagcaacctgggtggacccaggcctcaggcagcggtaggagtcaaagtgggggttatattttagaaatttaactattctgctatcaccagctttatttcctaatatacttatcaaaaatgcaaggaaaaacagaagaatcaatattaaggaaagtacagggatgaagattagaaaatggagataaccaagaagtctgtttcctctttttaatacagcacactttggaacagcaaatgaaagttatcttgttaagcattaagtgccaaactggtacaagcagcacaatcacaaatatttgagtactgaagctgactcataaaaatctaaaaatatttcatgctttaggctttcaaaacaccatcagtttaaccccttttcctccatcaatcgtattatcttgaaaccaatgtaaaaaatatttttaacccagttctggaaactgtaattgaaatgcagtgaaaacagaaagccacatgcaattagattctaaggcattatttcctacatttgatcctggatttactcaatcagttgttaagcacctgtgctactttactaaaataaatacacatatttaatttatgataagggttgtctaagagtcttaactgatatccctttcaggaaatatcaaaatccttaaataaaaggccattttaaaattaatcgtaatataactaaactctgttaaattttcaaagaattccagtttaaatcccagtttataatgtccttaacaggctgaaatctcttttctgatcaaaaccaagtgctatcatgtaaaatcaaaactttttaagttataagcataggaagccagtgaatttaggccaaaggtttttatttttttattttgtaaccatacactgacttgggttacaacgtatttcttataattcttttgaaaataaatacattttcgttattttttaaaggaatagaaatggaaggagctgggaacagccaatttcaaagaggcaccaagttacaatttttcgatatgaagtacttctgttgtaagtacatgcactgtgtgtacattcttaagaatatgtaatatacttagtcgatttaagatagttaccaaaataacccactacaaaagttacagaataccaaacacttgactacaagtatgataaattatgctgaaaaggaaaaatcactcagtatgtgacatccctttgaaaacaaccccacgtgcacacacacacacacacacacacacgcatgcaaaaatcaaaaactatcagtttctttttttccctcctagttttcaagaatgctagagaagtccagttctgtgaattatgcaaaggacagcaaacattaagctgcctccatatttatgctactgtacttccatttttaaaacaagcatctcaactccccagacaccatcatccacagaaaccatgcagctatccaacagactttcagtgtcaccatttattatttatagcgttaaatgggggaagtggctctgatgtcaccaaccctacccagtggaatcactgactcaataaacattttcacactgaagaaaatctggctaggaaaacattttgctgggttaagtagattcttccacctctcctctcaaccctggggaagaagttgttaccgtgttaggaaagatacaaagaaactgtcaaggcttccataggaagaaatcctggacatgtccatttgctgatgcagacttcctcttcccagctctccagagcccaatttgatttccctcatgttcacgttggcaggtaatatctgccatattttatttcttccaccaaatcatccatcaattagcaaattcttcacttctagccactctctcactgtcctgttcctaaaaaccccttctggtttcaaatcctaaagcttcggaggagggtggagggtgtccacggaccgggagtctggcctggctgccagtggtttctaacagaagagtggtcgcttcccccgggggccaaggattcccctcttttttttttctttctgagaagaaagacctcgcggcagtgatgaggatggctccctccccagtcatctccaatttcccaaagcagctctggaaaacgtgaagttgcgccttctctttcctggaggatggaatccagagtacctgggcccttgctatgcaaacatccctctccgccgggtaggaaaccctttgtccgagaagccggacaccacaagggcccgggaaagaggcctccttatccgccacagcctcaaacccgaaagctccctgcccccccagctctgtagggcctatcctggcatccacacagacctaggctggggagtgggtgctgagacctctcctaggacgcggaggcccaggcggccccaacccatctccgtactccttcccaccatctcactcggcctgagtggggcttgcaagcgcggtgcgggcctgggccgaaacagaggaaagaaaaaaaaatccctttctaaaagaaggagaatggggtgctagagcgagtgcgacctaagtctacagcataaacgagcgagggtcgtccgagagctgggaccggagacgggaccagggggagggggagaagcgaggggcatggagggggccgggccaggaccggccggagatgtcgagggatcagaggagcccgcgccaggtccgaggccagggaaggctgggggcccgggtctgggtcgaggcgtctgggaagggccagagccggcctcgcaccggacgttgaggtgggcaggcccgcccggggccggacggacggaagcacagacggtccagcgggccgcactcaccatgagctcgatggtcttgtcctcaatcaccgagtcgggctccatggcggccccggcggccccgcctcgctctccccgcgcagcagcgaacggcccgggcggaggaggcgacggcggaggcggcagaggcggaggcggctatcgcacccactctagctgccagcccgcccgggccgccggcagctccgccctccccctcggcgaacgcagtacgcagatcggggactacacctcccagcaggcgccgcggcccgcagagcgttgtgggaccgagcctctgacaccaggttgctggctcttggcagcccgaagctgaactccgagctgagagtagcactggacggtgggcgtaggacgtgcagacctgaagagttaagagcttgctcatggcagggcctcgagagcgccacgactac

SEQ ID NO: 2055 - DNA, 145323 bp, Homo sapiens; identical to SEQ ID NO: 2054

SEQ ID NO: 2056 - DNA, 145323 bp, Homo sapiens; identical to SEQ ID NO: 2054
